United States Patent 10,240,205 (METHODS FOR ASSESSING RISK OF DEVELOPING A VIRAL DISEASE USING A GENETIC TEST) - sequence listing, part 21

SEQ ID NO: 2164 - DNA, 54168 bp, Homo sapiens
ttcttactgcccccatccggttcggggaggtggcgggaccttggcggcgcccggagccggcgtggcgctcatcgagggacgcccggcccaagtggtaagttgaaaaatggcggaggggggaagaaggaggggctttgcagggcaggaggctgacctcccggccgggggtgggagggacacgccggggcccagtggcgcagcccgggctgggagactgacggaccgcgcccggtgtctctttgaggccctgacgtggacacacttcgggtttcacgactccgggtttctccaggggatgggccggccggtagaggcgcgtgagggagacgaagggacttccgtttccttcacctaggctggggccaagccgcagagcggagttggcatttccagattggggctcgggccgcgcctcctccgggaccctccccttggaccgagccgatcgccgcggggcagttcgggccggctgtcctggcgcggtgggtacagcttgtgtaggctttcccctcccccgctttccctccttcccctctcctccctcccctcttcttttcccctccacttccctcgggccggcgctgctggggagggcgggaaggccgcgccagcccatcaggggtggcccggccccggctgcttgcccgggttcctcggactgccgacggcaggcgtgggtgggtgggtgacttcaggcctgcaggattgccttcctaaaccctgtgacacctaaggtaaattgaggcaaagaactttttaaaaaaatatgatcaaagggatttcctccccatgtgataacctgtggcttgtgtggagcagggtggagtgtgtctggagagggcatatgaaactgaaagaataagggccaaagagcttccggaagaggaaattagctggtgattctttccaatctgctttcccagtcacctttccggcatgttctgtaaaacaaaatgtaatttgactttgtttcattattttaactccataacacttaaattgttttcttttcggggaggggagtgtttattctcaaactaagcagtagccctctccaccttcgaaaaaggaacaacgtcaatccaacctttgttaaaaaactccaacctatcagattttaataatctagtagtttgctttcaaatataattatgtcgctagttctgtcacaactatactttgatagtttaatgactcacagaaatttgtaagactggaggttgcagtagtgtttctttcttattcttttttttccccataatatttattatagtcaatgaacagtgttacagacggccatcttagaattataacattttagagttggaagggatcttagtcaaaccctgtccttttacaaaaccagaaaccacggcttaggaagatttcatagcttgctaaaggctatccaactagttagattagaacccatgttatctggcttcttgcccaccactcttactgcgcaattgctccatatcgcctccaagcatgaaaattaaatgtattcaattcaacacacatttctgaagagtataatactttgtaccagtgactgtggtaccactttctatgtatttcaatgtatttaacatgcttatggagtacttgagattcccccccacccccacattcaagaagtggcaacagtttagatttatacacacaccttcacatgtacgtgtgtatacttgcatttgctcagatagtttcttgaaggatacacaataaaaatgttaatagtaatgacttatggaggagaagagagatagaagactttttactttgtacttcacatgatctaatgtacggtttgaatttgttataaattcgtattgatttcataattgaaaagttttaaagttcacaccttcccacacaaatatatatatcaacataagcaagtatataccaatggtatgtacacatttatgtgcatatatgtatttatacatatcagtggtttgtactgtaaaatccggtatgattcaggtcaactcagctgacaaagcagacctcattattggatactcatgtttcgttttcttgtattgctctctcctaatgtaagatagtaaaaataatatgttactagtcgtcatatatttttagaaattgtcctaagcttcttgattatcaaataatgtagcaaacttttaacacatttaaaatatcaaatctgggtacttgcttcagtggtagcacatatactaaaattcgaacaattcaaagaagattagcatggtgtttttttttatcaattaattaattaatttttttttttgagacggagtcttactctgtcatccaggctggagtgcagtggccctatcttgactcactgcagcctccgcctcctgggttcaagctactcagcctccccagtagctaggactacaggcatgcgccaccacgcctggctaatttttgtatttttagtagacaccgggtttccccatgttggccaggctgatctcgaactcctgacctcaggtgatgcacccgcctcggcctcccaaagtgctgggattaaaggtatgagccacctcgcctggccagtccattttttttttttttgagacagagtttcgcttttgtttcccaggctggagtgcaatggcaccatctcagctcactgcaacctccgcctcccaggttcaagtgattcttctgcctcagcctcccaagtagctgggattacaggtgcccaccaccacacctggctaattaggtcccttttttttaataaaccacaagaaaaatttgacacctgacgctgtggctcatgtctgtaatcccagcactttgggacgccaaggcgggcagatcacctgaggtcaggagttggagtccagactggccaacatggtgaaaccccacctctactaaaaaaactagccgggtgtggtggcgtgcacctgtagtaccagctacatgggaggctgaagcaggagaactgcttgaacccaggaggcagaggctgcagtgagccgagattgcaccactgtactccagcctgggtgacaacagtgcacctttgtcccgaaaaaaaaaaaaattgacacaaggaaaatatctgcagcctgggcaacatggcgcagccctctctctaataaaaatacaaaaattagccgggcgtgctggcttgtgcctgtagtcctagctactttggggagctgaggcaggaggatcacctgagccttgggaggtggaggctgcagtgagccatgattgggccactgtactccagcctgggcgaaagagtgagaccctgtctcaaacaaaacaaagaaacaaaaatctgaattgtagactctttgtagataagaacatattttttaaaaaagttaagactagggccaagtgcggtggctttcacctgtaatcccagcactttgggaggctgaggtgggcggatcacctgaggtcaggagttcaagaccagcctggctaacatggtgaaaccccatctctactaaaaatacaaaaattagctgggtgtggcggtacacccctgtagtcccagctacttgggaggctgaggcaggagaaccacttgagcccatgaggcggaggttgccgtgagctgagaacgcaacattcaactccagcctgggccacagagtgagactccacctcaaaaacaaataaaaagttaagactaaaacagtttatagtgattaggagttcagctgtctagttttgtttttgttttgagatggagtttcactcttgttgcccaggctggagtgcaatggtgcgatctcggctcacctcaacctctgcctcccaggttcaagcagtttcctgcctcagcctcccgagtagctgggattacaggcatgcgccaccacgcccggctaattttgtattttcagtggagacggggtttctccatgttggtcaggctggtctcaaactcccgacctcaggtgaaaaagtgctgggacctcaggtgaaaaagtgagtcactgcacctggcccagctgtctcgtttttagaaatagattaagactcaaaaaaaatattgcccaccgtaatatatctgattattagcaaagcttggactagagtctaggttctagtctagtggcccttgtactatacctgtaattttattgctttctagtgcattggatgattccaactaggctgacaaagtaataatatctaaaggttagccaggaccatttcaatagttaagaattattatttttttctttggtttttattttattttgtcttccttttttttttcattttcaggaagtgagcagtttctcaaaattattataattaatggaccagctaatttgtatagtgcttaaaatattttagtaacataaattttactaaataaatttactaatttagtaaataaatgttctccttttatttcattgtaaacattaatttctttagtaaatcctgtatttatattgtaaatgtttagcgataaaataatgatatttcactgtttttgtttggtctaatatttaagtctggtaggtagtattagcagagagcaaaacctacagtttatgaaataaacattcattgagcacttaatgtgttccaggcattcattgtagtatgtggtaggattccaaggataaatatggcaaaacaaatgcctttcttctgttttttttttttttttttttttttttgagacgacggagtctggctctgttgcccaggctggagtgcagtagcgcgatcttggctcactgcaggcactgcctcccggcttcacgccattctcctgcctcagcctctcaagtagctgggactacaggcacccgccaccacacccggcttagagtgtgtgtgtgtgtgtgtgtgtgtgtgtgtgtgtgtgtgtgtgtgttttagtaaagacagggtgtcaccgtgtgtgtgtgtgttttagtaaagacagggtttcaccatgttagccaggatggtcgcattctcgtgtgtgtgtgtgtgtgtgtgtgtgtgtgtgtgtgtgtgtgtgtgtgtgttttagtaaagacagggtttcaccgtgtgtgtgtgtgtgtgtgttttagtaaagacagggtttcaccatgttagccaggatggtcgcattctcctgacctcgtgatctgcctgcgttggcctcctaaagtgctgggattacaggcgcgagccatcacaccaggccgcctttcttcttttttttttttttttgcttttttatgttcgtctgtttttattttgcttttgtgtgtttgtttgtttttccattgttcttttgaggctgggagattatcatgagctgtcaattctcaagctttatctctgtgagataatctggtaatagttttataaaatgtaacctgttagcactattaaaggacattgtgtgagtagatatgaagagacaaacagtagtgataagataaaaaatactttagaatttaacaaatactgtttctgtatcttagaggtcatgtgctacagtgtttggaaagagccctacgttgggtaccacagtacaggttattgactttgtttccaattagctgtgggattgtgcatgtcaatgaccccatctttctttacatgttcacatttttgatatgttattttaggtgttgaattcaaaacataaaaagggtattttaaggccgggcgtggtggctcacgcctgtaatcccagcactttgggagactgaggcgggcggatcacgaggtcaggagatctagaccatcctggcacccctctctgctaaaaaaaaaaaaaaatacaaaaaattagctgggcgtggtggcaggcgcctgtagtcccagctacttgggaggctgaggcaggagaatggtgtgaacccgggaggcggaccttgcagtgagccgagattgcgccactgcactccagcctgagctacagagcgagactccgactcaaaaaaaataaaagggtattttgaatattttattttatttatttgtttttgagacattgtcttgctgtgtcacccaggctggagttcagtgcatgatcccagctcactgcaacctccacctcctgggttcaagtaattctggtgactcagcctcccaagtagctgggattacaggcgtgtgctaccacacctggctaatttttttttttttggtatctctttttttcccctcggagacagagtcttgctctgtcgcccagagctggagtgcaatggctgcgatctctgttcactgcagactccgcctcctgggttcaggcaattctcctgcctcagcctcccgagtagctgggattacaggcgcacgccaccacaactggctaatttttgtatttttagtagagacggggtttcaccatgttaaccaggttggcctcgaactcctgacctcgtgatccacccacctcagcctcccaaagtgctgggattacaggtgtgagccaccacacccagccttttttgtattttaagtagagacaggatttcaccatgttgcccaggctggtcttgaactcctgacctcatgtgatctgcccgccttggcctcccaaagtgccaggattacaggcatgagccactgtgccggcctttgagtattttaagttataaaagaaatatgtgtttctatatatattatataatatatattatacatgatatataatatatatgatataaattatattatatacaatatattatatatgattaatatataatatatgatatatcatatataatatcaaaatatataatatgtatataataatgtatgatatatataatatagtatataatatattacatgtataatatattatatataatatataatacaatatatgtaaaatatatataatatataacacaatataatatgtaaaatatattacatatataatatatatatttttcagacagagtctagctctgtcacccaggctggagtgcagtggtgagatcttggctcactgaacctccgcctcccaggttcaagcgattcttctgcctcagcctcccaagtagctgggactacaggtgtgctaccacacctggcttattttattttatgtatttatttatttttctgagacggagtcttgctcctgacctcatgtgatctgcccgcctcggcctcccaatgtgctgggattccaggcatgaaccaccgtgcctggccagagatatgtgtttattatagaaaatttatgaaatagaataatgacgatcatattgtctacaggttgttttaatccccccccccccttcaacattctatagttaacatttctgtttttttttttgagacggagtctcgctctgtcgcccaggctggagtgcagtggtgcgatctcagctcactgcaacctccgcctcctgggttcatgccattctcctacctcagcctctctaagtagctgggactacaggtgcccgccaccacgcctggctaatgtttttgtatttttagtagagacggggtttcaccatggtctccatctcctgacctcgtgattagcccgcctcagcctcccaaagtgctgggattacaagtgtgagccactgcgcccagcagtcttttttttttttttggtttggtttggttttttagacagagtctcactctgtcccccaggctggagtgcagtggcacaatctcagctcactgcatctccgcctcctgggttcaagtgattctcctgcctgagcctcctgagtagctaggattatagacatgtgctaccacgcccggctaatttttgtatttttagtggaggcatggtttccccatgttggccaggctagtcttgaactcctgaccttgtgatccgcccgccttggcctcccaaagtattgggattacaggtgtgagcccccgtacctggcctttttttttttttttttttgagacggagttttgctcatgttgcccaggctggagcgcattggtgcaatctcagctcactgcaacctctgcctcctgggtttaagtgattctcctgcctcagcctcccaagtagctgggattacaggcgcacgcacaaccatgcccagttaatttttctatttttagtagagatagtgttttaccatgttggccaggctggtctcgaactcctgacctcaggtcatccacctgccttggcctcccaaagtcctgggattacaggcatgagccactgcgcccagcctgaagtctttcaaaatacattttttatttatccagtgtattattttatactgcactttcttcatctgtaaagtaacagggtcaggcatggtgactcatacctgtaagcccagcactttgggaggctgaggtgggaggattgtttgagaccagcctgggcaacatcgtgagaccccgtctctaccaataataaaaaaattagctggatgtgatggcacgcgcctgtgaagatcgcttgagcccgggaggtcaaggtggcagtgagccatgagggcaccactgcattctagcctgagtgacaagagtgaggccctgtctcaaaacaaacaaacaagcaaacaaacaaacaaaaaacccagggtggctgggcttaaggactagttgattccaacgattcaaaacccattataatagtttttaagcctgattatctgagattttgtcaaggaaaaaaattccacataacaatcccaggccaggcatggtggctcatgcctttaatcccagcactttgggaggccaagtcagggagatcccttgagtccaggagttcaagaccagcctgggcaacatggtaaaatgctatctctactaaaaatagaaaaattaactgggcatggttgtgcgtgcacctgtaatcccagctactctggaggctgaggtgggaggatcacttgagcccaggaggtggaggttgcagtgagtcaagatcagggcaccccattccagcttgggggacagagcaagaccctatctcaaaaaacaaaaacaggaatttgaggccaaatttatggattatatattttatctgctctgtatgtggttaataataggttatcctttatatgataaaaacatacttatgtccattttgcaggacttggcatgggcttttattgttttaaattgtgatacatttgtagctctgctgtttgatacattttgggatttgattttggtatgatttggtacccagtctttgttatggatacatgtgattcaccttgttatgatatagttttatgtattttcgaggatatgggtcatagtgaaaagtcacgtttacctgtacagactgagaatagcttgatctcagatggtcagatgttgaaccaagtggattaaagctgatttcttaaaccggacaaggctgctgccattgtgcattccctggtacttataaaatattatggtttgaaattttattcttatttctgtaatcatcttattcaccttaaatacagaaatacagacatctggctgggcgcagtggctcacacctgaaatcccagcactttgggtggccgaggcaggtggatcacttgaggtcaggagttcaagaccagcctgaccaacagagcaaaaccccatctctactaaaaaaatacaaaaaaaaaaaaaaaaaaaaaagctgggtcatgcctctgcaatcccagctacttaggaggctgaggcaggaaaattacttgagcctgggaggtggaggttgcagtgagctgagatcatgccactgtactccagcctggatgacagagtgagactccatctcaaaaataaagaaaagaaaaaaaaaacacagacatctcagcatatattaccatgtgacttaacctttctatggttctagctaattttttaggccttgaaagggaaggaagcctaacattttctgctacctcattggactgtcccttctgccagtaatccttgtagtaatttccttagacctatattggtcataatcactgggtgcatgacctttgatgagtaacagtcagaactactgtttcctcatatttcagatgaggcctatgatatattatgtaggttaaattagattccatatatgaaaacattctaaattgtaaagcacattacatatgttagttattatcaaaggtaacatcgtgaaagaagagaagatgagctatagaatcacacaagcccatgcttaaattttgaccttacattaaaccaaagaggattgatttttttttttaattgagacggagtctcgctctgtcgctcaggctggagtgcagtggcgcaatctcagctcactgcaacctctgccgcccaggttcaagcgattctcgtgcctcagcctccttagtagctgggactacaggcacgcgccaccacgcccagctaatttttttgtatttttagtagagacagggttttgccattttggcgaggctggtctcgaactcctgacctcaggtggtctgcccacctcaacctcccaaagtgctgggattacaggcttaagccaccatgcccagccaagattgaaaatttttagtttaaattcagcatgtttagtagagaagtacttacttgtagctaaaatgatgggatgaaggaaaatgaaaattagtttgtagatagtatttgggtacatgcggacactcatgaaatatgttgtatcgtttaaatttggtttgtagcacagtttcctttactttgtgtcatttaaaaaaattaaaacctagacagaagagaaacgtactaaatgtttgaatatagatagcactgtggctttcagatagagttaaatatttttactgaagaaagagaaaagatgtgggctcttatccataacttgtttgatcagcctgggcaatatagtgagaccttgtctctacaaaaaaaaatttaaaaattagctgagtgtgctgtcgcctgcctggagtccagctcctcaggaggctgaggtggtaggattgcttgaaaccgcaaggcaggggttgcagtgagccaagattgtgacactgcactccagtctgggcgatagagcaagaccctgtcccagaagaaaaaaaaaagttgtttaagtacttgcttgagatcctaacatgatcatggaatagaatacttcactctgaggtgagaagatcacttgaggccaggagttcaagaccagcttgagcaacatagtaagaccccatctctttttgtgtgtgcgtgtgtgtgtgtgagggagtcggagtttcactctgtcagccaggctgctggagtacattggcacgatctgggctcaatgcaacctccgcctcccaggttcaagtgattctcctgcctcagcctaccgggtagctgggattacaggcatatgccaccatgcccagctaatttttgtatttttagtaggggccgggtttcaccatgttggccagggtggtctcgaactcctgaccaagtgatccacccacctcagcctcccaaagtgctgggattacaggtgtgagccaccacacctggccatgagccaccaagcctggtcgagaccccatctcttaaagaaaaaaaaaagaatacttcgttctgagaaatgtctaggggtaggtattacctgcttatgaagtcatccatggcatttctggaaccatctgattgtatgaactgctttctaatcactctgtcagaataagttatctggacaaagtatcagagtacagtaagttccggttccatgccactaatcagctctatggccttagtcaaatcatttaccttccttatgttttagtttctttttctttctttttttttttttgagacaggatctggttctatcagcccaggctggagtggccaggctcaagtgatcctcccacctcatcctcccgagtagctgggactacaggctccagccaccatgccttagttttttggggttttttttgtttttttgttttttttagtgactgggtctacctatgtttcccaagtggattagtttctttttctgtaaagtaagagaatgatttttattatcctgtccagcaagacatagttattatgaacaatttttgctcgtgagtgtctacaaaatataataatggccgggtgcggtggctcatgcctgtaatcctagcactttgggagaatgaggcgggaggatcacgaggtcaggagatcgagaccatcttggccaacatggtgaaaccccatctctactaaaaatacaaaaattagctgggtatggtggcacgtgcctgtaatcccagctactctggaggctaaggcacgagaattgcttgaacccaggaggcggaggttgcagtgagccgagattgtgccactgcactccagcctggtgacagagcgagactccatctcatagtaataataataatgatgatgctttttagtatacttgattctgagctgctcgttttgttaaaattattttagggaagtttttgcccaaagttcgcggatacttctttcttcttaccaggccccaaagtcattgtaaatttttacaaggcagtggatgaacagttcataactccaaagatagatatcactcagaaaaatttttccacaagaagtccttttttttttttcgtcctttttttttttggcacactagtgtctcacttagcaagtccttttattttcaactcaagttaacaataagttggccgggtgtggtggctcacgcctgtaatcccagcactttgtgaggctgaggcgggcagatcacctgaagtcagaagttttgagaacagtctggccaacatgacgaaaccccgtctctactaaaaatacaaaaattagtcgggcatggtggcgcgcccctgtagtcttgctactcaagaggctaaggcaggagaatcacttgaatttgggagatggaggttgcagtgagccgagatcacgccactgcactctagcctgggtgacagagcaagactccatcacaaaaaaagaaacccaataagtagcaatcaggtatcacctgtgtttctcagcccttctcttctgctgctggtttactgccactcaagcagtggaccaaaaggcatttgtttctggccaaccaccatggacatgatctgatgactgcttttatctctgggacttgacctgtatccctctctctctcttttttttggatagcttttcattctgtctcccagggtacagtgcactggcacaatcatagctcactgcagactctgcttcccaggctcaggcagtccttccacctcagcttcctgagtagctgggactacaggcatgtgcaaccatgcccgactaatttttaattttttttttttttgagacgaaatttcgctgttgttgcccaggctggagtgcaatggcgcaatctcggctcaccgcaacctcggcctcccaggttcaagtgattctcttgcctcagccttcctgagtagctgggattacaggcatgcgccagcacgcccggctaattttgtatttttactagagacggggtttcttcatgttggtcaggctggtctcgaactcctgacctcagatgatcctcccgcctcggcctcccaaagtgctgggattacaggcgtgagccaccacacctggcctaatttttattttatttttttttgtagagatggggtctcaccatgttgcccaggctggcctcaaacacctgggctcaagcagtcctcctgccttgacctcccaaagtgctgggaatacaggcatgaaccaccatgtctggccctctctctctctcttttttgaaacctgatgatcgccaggcacggtggctcacgcctgtaatcccagcactttgggaggccaaggcgagcagatcacttgagatgaggagtttgagaccagcctggccaacatgatgaaacgctgtctctactaaaaatacaaaaatcagccaggcgtcgtggcggcacacacctgtaatcccagcactttgggagtctgaggcaggtggatcacttgaggtgaggagtttcgagcccagcctgaccaacatggtgaaaccacatctctactaaaaatagaaaaaaaaaaaattagctgggcctggtagcacacgcctgtaatcccagctacttgggaagctgaggcagaagaattgcttgaacctggaaggtggaggttgcagtgagcccaaattgcgccactgcactccagcctgggcgacacagcaagagtccgtctgaaaaaaaaaaaaaaaaacctggtgggttgctcagaggcagttacctatgtaacaagctggcagaaattctcaggataggcaaaaagataagaaccaaagaacatatccttccctttctaagtcataaaaattacttcctgtgaatgaaaagccaaaactttgcattaccaggccttgctattgatagtttacttggccagtgtattcacagagggaggaagcattgtcacatggcaaataaccagattacacccatagtctggttggcaggattgtacaagggtgcctgactaatcaagagtccacctgcttatttcttttcattagaatctaatatatttgctgtatagaatttagaaagttaagaaaagcgcaaagaaaataatctcactgctcagagataaccacagcagaattttgatatgtaatttagcctgtctttatatatctgtattttttataatttgggttatataatacaacatcattttgtaaccagctttttccacttaatacaacatcatggtgctcgctttggcagtacatatactaaaattggaatgatacagagaaggttaacatggcccctgtataatatatgcatgtttttaaaatacatcctgaacatgaatttttaatggttacctggtggcccatattaccatagtattgtcctcttttgttagatattgaattgtttttagtaaatagcactttatggaacatccttatatatacactcataatgaaatgatgggggattttttttttttttttttgagatggagtctccctctgttgcccaggcttgaatgcagtggcgcaatcttggctcactgcaacctccacctcccgaattcaaacaattctcctgcctcagtctcctgagtagctgggactacaggtgtgtgccaccacccccagctaattcttgtattttttttttttttttttttttttgtggagcctaggttttgccatgttggccaggctggtcttgaattcctgacctcaagtgatccacccaccttagcccccaaagtgctgggattacaggcatgagccactgcgcctggctgatcagggatttatttttttttttttttgagatggagtttccctcttgtttcccaggctggagtacgatggcacaatctcagcttactgcaacctctgcctcccaggttcaagtgattctcctgcctcagcgtcccgagtagctgggattacaggcgtgcaccaccatgcctggctaattttttgtatttttagtagagacggggtttcaccatggccaggctggtcttgaactcctgacctcaggtgatccgcctgccttggcctcctagaatactgggattacaggcgtgagccaccgcgcccggcctgatcagggatttatttatttttatttttttgagaatatgtttagaactagaatggatggttcaagagataatcatatatttaagacttttagaacatatattgccagattaccttccagaaaagatgtaccagtttttagttctaacaggcaaatgcctcttgcttcatactctccagccactgcgttttcgttgttggtagtaatgttgacctttgccaaataggataaaaatgttatcttttaaagtgtttatttctttgattattaatgaggtttaacattgttgcatatgtttgttgaccattaatatttcccacttgtaaatttgcctgttttctatcaacgtattaatctttttcttatagattttttttttttttgagacggagtctcgctgtgtcgcccaggctggagtacagtggcaccatctcggttcactgcaacctctgcctcccaggttcaagcgattcccctgcctcagcctcccgagtagctgggattacaggcatgtgccaccacgcctgactaatttttgtatttttagtagagacggtgtttcaccatgttggccaggctggtcttgaactcccgaaatcaagcgatccacccacctcggcctcccaaagtgttgggattacaggtgtgagccactgcacccagccttcttatagatttataagtgtattcatactactttttttgttttttaagacagtgtcttgacctgttgtataggctgaagtgcagtgacgcagtcacagctcactgtaacctggaattccttggcctacattgcccagtctggtcttaaattcctgggctgaagtgattctcccgccttaacctcccaaagtgttgggattacaggggtgagccaccgcatgtgacctcatgctgctttttttttttttccaactactttagtcagatgcttcttgagactattactagtcaaaaacaagatagattaaatggaggtagtgacaggacactgccctgtttgaggccatctattattggtgtgaaaagcaaacattacataagtaggtttagatagaaggtcattcactccagcattgttcataatagtaaaaaactagtcaaacacagtggttcacgcctataatcacaacactttgggaggccaagtcaggagtatagcttgagtccaggaattccagaccagcctgtacagcatagagaaaccacatctctaagaaaactttttaaaattagcagggcatggtggcatgtggctatagtcccagctactcaggaggctgaggtgggaggattgcttcagcccaggaggtcgaggttacagtgagctatgatcacactactgcactccaactcgggcaacagagcaaggccttgtcttttaaataaataaataaataaataaaaaggaaaataatatgagtaaactctacccatcagtggtaaataccacatatttctatcaatgttaggcagtcttcctagaataatcccattaaagaaaatccaaaatcgttgtatgaaaaaatacacaggtttgttccatgtgtaaaaatcttttaatcttggtacattttttatcaaaaacattcacactacttgaatacattaaaagagtacaaaagcattccaatgtacatatggacacacaaaacacagggaatgctttctagtgaaattaggagtaaatacaagaatgttaaaggagagagtctcatattaccagagtcagtgaattaattgcctttttttttttttttgagacagagttttgctctgtcacccaggctggagtacagtggcatgatctgggctcactgcaacccccgccttctgggttcaagtaattctcatatctcagcctcctgagtaactgggattataggcatgcaccaccacgcctgactactttttgtatttttagtagagatggggttttcgccatgttggccaggctggtttcaaactcctgacctcaagtgatccgcctgcctcggcctcccaaagtgctgggattacaggcatgagccaccacgcccggccattaactgctttttacaacacaaactatacctgtttggaattagtttttaaatatataagctacaggatgtacaaacaccaatgtgaacaactgtcagagaattttgtaattcaggaacatagcttcaagtgcttcataacatggaaagcaactcctaaaaatagtaattggcttaatttcttaaaagcattccagaaagtgatttgttacaattagcaacagaagaacaacattagaaataagaatactgggaacataagaactgaggtcctccagtaccaagagatagaatcaaactttttctcattagaatttaaagaatatagccacgcacggtggctcacacctgtaatgccaacactttgggaggctgaggcgggtggatcacgaggtcaggaggtcgagaccatcctggctaacacggtgaaaccccgtctctactaaaaatacaaaaaaattagccgggcgtggtggcgggcgcctgtagtcccagctactcgggtgactgaggcagaagaatggcgtgaacccgggaggcggagcttgcagtgagccgagatcgcgccactgcactccagcctgggagcgagactccgtctcaaagaaaaaaaaaaaaaaagaatttaaagaatatagttaaaggaaaaattcactgggctctgtgaaacaggttaaatatgtaaccacttcaaacagaaatgacttagtcctctcacctagttctgaaaatgtactaacatcccattttccatatcaaaagcacgtaatttcattagcaaaagcctctttgttttagacttaaaatcacctctgatccaccaaagtttatgcagttaccaaactactattttaataacattttgacagctttattaagataaaatttatataccataagatccatttaaagtatatagttcagtggcttttagtatatgcagagttgtgcaactatcaccacaatctaattttagaacattttcattactccagaaacaaccccagtaaccatttgtagtcacttcctatttccccctccccagccctaggcaaccactaatctactttctgtttctatttattttaataacatttcaaacttgtaatattattgttctcatgcttattctgggtcgttggctcagaggtttaaaagctcttaaactacccaaatttacaagtcctatgacatcctcattcagaaaacattcaaatgatggtttcataatgttatgatagttccatcttctaagagtttttgatctggagcatatgtttcaaattctatgtttgtactactgctaaattcacttaattagaagaagtaaaatcattctatcgagactcaagaatgagtttgttctgtttatgttaacgattccaggcttttgatggtaggaatggctttagcagtcttctgtggcacaccattatcttaaataatattgtcaccttccccactgtcttcatcctttggctcaaagtttggttcaatctgctgtggttaggcaagaaggctattatcagcagattggctggagctaccagaagtctgactgttcccagtaacattattctcctggttgctggtctcactgttaggatgaggtggctgctgtttgcactcatcatgtctgtttacttgattgagatgcttccctgaaacttatgtaccatcaacttctaaaaacttcatcattaacagttcatagttctgtgctgtgagccaggcctggaacaagccaggatataaaagatccctgggatgctctctaagccatgtggtgtctcccttaggctagaaccatcctggatatagagtcctaggggatgcttagttcctgggagaacatccacatctatgattgaagacacgggtctgaagtcttagggcatagcagtgactggatatagcctttttctgtggttgacaaaaccacagaaagagtttttttttttttttttttttgagatggagtcactctgtcacccaggctggagtgtggtggcacaatctcggctcactgcaagctccacctcctaggttcacgccattcccctgcctcagcctcccgagtagctgggactacaggcgcccgccaccatcccagctaattttttgaatgttcagtagagacggggtttcaccgtgttagctaggatgatctctatctcctgacctcgtgatccgcctgccttggcctcccaaagtgctaggattacaggcgtgagccaccgcgcctggccagaaagagaggttttaagtgacaatattattaaagacattctggagaaaaagatcacctataatcccgtcaccttaacattttctcgatttatttaatattactttccgagtcttgtctataagtatacattttcatacagtggtaatctggcgtgcattctaccttatatccttttccccattaaaataacctttattctacgtatttgaaaaccttggctgggctcagtggctcacgcctgtaatcccagcactttgggaggccgaggcgggcggatcacgaggtcaggagatcgagaccatcctggctaacacagtgaaaccccgtctttactaaaaatacaaaaaattagctgggtgtggtggcacgtgcctgtagtcccagctacttgggaggctgagacaggagactcccttgaacccgggaggcggaggttgcagtgagccgagattgcgccactgcactccagcctgggcgacagagcaagactccgtctcaaaaaagaaaaccttaaggctgggcgcggtggctcatgcctataatcccagcactttgggaggccgaggcgggcggatcacctgaggtcaggagttcaagaccagcctggccaacatagaggaaccctgtctctactaaaaatacaaaattgccgggtgtggtggtgggtgcctgtaatcccagccactcaggaggctgaggtgggagaatcacttgagctcaagaggcggaggttgtggtgaaccgaggtcgtgccattgcactccagcctgggcaacaagagtgaaactctgtctcaaaaaaaaaaaagaaagaaaaccctaataaaaaaaaaaaaagcagcctggcacagtggttcacacctgttatcccagcactttgggagttcgaggcaggtggatcacctgagatcagcagttcaattccagcctggccaacatgttgaaaccccatctcttctaaaaataaaaaaattagccaggcgtggtggcgggcgcctgtaatcccagctacttgggaggctgagacaggagaatggcttggacctgggaggcggaggttgcagtgagttgagatcacgccatttcactccagcctgggccataagagcaaaactctgtttcaaaaaaaaaaaaaaaaaaagggagaaatagaaacttttgtgtcgtatacagacaccagggttttgtatgtgcctttgtctctgtatcccccacctccacattcccacattctcgctagattagctgtcaacctcctctccttggcacctcctggtggctctctttacgcagttgactggactaaatgtatgtacatacatgtatactgtaaaaccttacatatcaccattgtagaatctcccaaacccttcatttaaacatgcaccattgcttgctggtcctttttgtcccattttttgcttccatagtgctattttcccaactactgttacccttaagattcctgacttcccagcccctttataccaaaagctttctttgacatttttctctttccgtgccttcctgcctttccacttacccagtacaaagcctgaagatgctttcacagagaagccttaaattatcccagcatactttattgcacccacaccttttcacttcaaaaacctttttgtcacccttgtctaatattcataccctattttcttctatattctcaattcatctgctccatatatacttgttttctgtggtatcattttccccacctccatttcacttagatcctatatttttttaccctatcttaccctttttgtttggtgccttcctccaaacccaaggtttctgtctttcatcagtcatccttccacctttcactcttaaactctggtaattctggttttcctccttctcaaaaagctcacactctgctaatgtgtatatattgttcacttgagtgcttctaaataaatatttacttttcaaaacagtgaaatctgaactattagcatggaaacaacctctgggaagataagatctccactcaaaagcttcaaattgagattctcctgctcatgttgaatgatggttttatctaatattttctgaaatagggtgactacttgaactacacaaaattgtgaaatgagaatatctttgattttatacttctatttttttttttttttttgagacagagtctcactctatcacccaggctggagtgcagtggcagtcttggctcattgcaccctccacctcccaggttcaggtgattctcgtcccttggcctcccaagtagctgggattataggcatgtgccaccacacccggctaatttttgtagtttttggtagagatggggtttcaccatgttggccaggctggtcttgaactcctgacctcaagtgatccacccacctcagcctcccaaagtgttgggattacaggcgtgagccactgtgcctggccacttacatctattttgattgacttgaaataaaatttaacacctcagggaaggcaattctcatgtgttttgaattatactgagcattaattcttcaggataattatagacttggaaaggtttaacccagtctcccagtccatgctgaagttcctttaagtgataggaggaactcataatctacaaggcaacccaatccatttggtgctaccatcgattgttataaagcccatccttgggttaaaatctactatttacagttgtatttaatgaccttaattctgccctcaagctatataaaatttggatctgttttctacatgataatcttttagatatcttaaggtagttagtctatcctctctacccttcccctcacagtttttccaccctttgagataaatatccttcgctattccaactatttctcatatggtatcatttttatcatcccgattgctccctaaggatgttaaactttgttaatgtcccttccaaaatgtatttggaactggaaataatatcccttggtagctgaattggatctggatgttgcacatctggacactaatgcagtctgaagttgctgtaagttttttagtcgacttgtaatgttggcttatgatgaatttgtaattaaataaaatcccaaggttttaatctggaggattgcctttaagtgatttcttcttaaactaagtctcaatcttcttttagttatgcaacagattttttttgtttgttttttgagacgctcgctctgtcgcccaggctggggtgcagtggcacgatctcagctcactgcaacctccacttcctgggttcaagcaattctcctgcctcagcctcccaagtagctgggattacaggcatccgccatcatgcctggctaattttctttctttcttttttatttttttttagtagagacggggtttctccattttggtcaggctggtctcgaactcctgacctcaggtgacccaccctcctcagcctcccagagtgctgggattacaggcgtgagccatcacgcccggccttttttgagatggagcctcgctctgtcgcccaggatggagtgcagtggcatgatcttggctcactgcaacctccgctccccgggttcaaggcattcttctgtttcagccttccgagtagctgggattacaggtacctgccaccacgcctggctaatttttgtatttttagtagaggtgggggtttcaccatgttggtcaggctggtctcgaactcctgacctcaagttatccggccaccttggcctcccaaagtgctgagattacaggcatgagtcaccgtgtccggcctatgcaccagatattttttaaaaaccagatgtaagactttatacttatccctattaaattttatctcattagcctatcaggtagccttggtttttttcttttcttttcttttctttttttttttttttttgagacagagtttcactcttgttgcccaggctggagtgcagtggcgcgatctcagctcactgcaacctctgcctcccgggttcaagcgattctcctgcctcagtctcccaagtagctgggattacaggcatgctccaccacgcccagctaattttgtgtttttagtagagacagggtttctccctgttggtcaggccggtctcaaactcccgacctcaggtgatttgcccacctcggcctcccaaagtgctgggattacaggtgtgaaccaccatgcccggctgttttttttaagactagtcaagtgcagagtgagaaggggggaaagagtagaacaaggagtttgatcagccttggtttctttgaatcttgatttttgtcatccagtttattgtgctgattcaacaaagggccttgaagctaatgttggaatgttttcagacatataggaaatgataattcatcaaaagtcatggagactatattccaaaagttttatgcagatataactcagctgttgaggtatatgagttaataccactataaattgacatggccaggaaagactgaagtccattgccagcttgctttgtgttgaacattactccaaaagagattaaattttaaggcatattgtgtcaacataaaggcaaaagagctggctaattcttctcaagaaatcaattaatggcagggcgcggtggctcacgcctgtaatcccagcattttggaaggccgaggcgggcagatcacctgaggtcaggagttcaagaccagcctgaccaacctggagaaaccccgtctctactaaaaaatacaaaattagccgggcatggtggcgcatgcctgtaatcccagctacttgagaggctgaggcaggataattgcttgaacctgggaggcggaggtcgcatgaaccagtatcacaccattgcactccagcctgggcagcaagagcaaaactccatctcaaaaaaaaaaaaaatcaattaatgcacgcataatatagagacagagtcattgttaccattctcttattttgcctttgacaagtttatattgagcatgttatcaggcaatgtgggagattctggagaaccaggtttgcctcataactagggttaccatatactctagtttgcctggggcaaccctgatttatgcctgttgtcccagtgtgattattactagtgtaatttttcactttgagaagtgtccaggtttggaggataaattatctttctaataattgatacccttctcataacctaacgggttccttttagtattttatctgggttaaaattaccagctgtaatttggcagctctaataagactgcagcaatacttatcttccatttgaacagattgttacttgaccaagggaagttaatagcaaaagtaactgcagggcacatgtatgtcatgggcaaaaaaaaaaaagtaacagcaattaaggtttgcaggtacttagaatttttcctgagccaccctctagagggcagtgttacatatatatctgtaattatccagttacaacaaaaaaagggctctcattcatgcatgaaaatcagaaatatttcatactcttaaagaacacattggaaccaatattatgattaaaacatattttgctaagcaaagagatattaaaaattaattcattaacattctgaacattttttaacttgtaaaaacaactttgatgccttgaatatataatgattcattataacaattatgcatagattttaataatctgcatattttatgctttcatgtttttcctaattaatgatttgacatggttaataattataatatattctgcatcacagtttacatatttatgtaaaataagcatttaaaaattattagttttattctgcctgcttaaatattactttcctcaaaaagagaaaacaaaaatgctagattttactttatgacttgaatgatgtggtaatgtcgaactctagtatttagaattagaatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtaaactttattataaaaccaataaatagcttcccaagtatgccagggctcataaaaagtaaatagatgcccttagccccctgaactggtaaatatttaggtataacttggcatgattatatatatatctgtattattccgtgaactcttatgttgaacctgtaatgtaactactgaatttatgtgaaaaagactaccatattatgagtcatgcttctcttcatgtaattgtttttaggaagtagataacttgcaaaagatggtagacatccccaatagcaaaatgggtctaatagtaatattaaccatcatttattgagcacttactataagtgctcaatacatatacttcatgcattttctctaagcttcacaatagctttgtttgtttgtttttgagacagagtttcgctcttgttatccaggctggagtgcaatggcgtgatttaggctcaccacaacctccacctcccgggttcaagcgattctcctgcctcagcctcctgagtagctgggattacaggcatgtgccaccacgcccggctaattttgtatttttagtagacacagggtctctccctgttggtcaggctggtctcaaactcctgacctcaggtgatccacccgcctcggcctcccaaagtgctgggattacaggtgcatgcaccatgcctggctaatttttgtacttttagtagagacagggtttcaccatggccaggctggtctcgaactcctgaccttgtgatccgcccgccttggcctcccaaagtgctgggattacaggcatgagccactgcgccggccatatgagtactttcaaatggactgtggtagacatttcaggaagggccattggagtgattgcttctaaagatattttaaaaagttataccattatatatttgacccatttattttaagattgaataatgcctataaaatattggttatttcgaaagattttatttatgtaccatcatatagtaatcttgaaggtttgtttagtgtcatgtagctataaacttagagaaacttacaatttcattatgtagaactttaatgttactaatacttgaaacataacttgttttaaaatttcacagtttgaaacagtaaggacaatattggtggcccaaataacatactaaaaagaaagtatggccgggcgcggtggctcccgcctataatcccagcactttgggaggctgaggtgggtggatcacctgaagtcaggagttcaagaccagcctggccaacatggtgaaaccccgtctctactaaaaatacaaaaattagctgggcgtgatggcatgcgcctgtagtcccagctacttgggagactgaggcaggagaatcacttgaacccagaaggcagaggttgcagtgagccgtgatcgcgccattgcactccagcctgggcaacaagagtaaaactccatctcagaaaaaaataataataattaataaataaataaataaataaataaataaataaatgaaaataaagtatgccaggtacagtggcttacgcctgtaatcccaacactttggaaggccgaggcgggtggatcacttgaggtcaggagttcaagatcaggctggccaacatggtgaaaccccatctctaccaaagatataaaaaattagccgggtgtggtggcgcatgcctgtaatcccagctacttgagaggctgaggcaggagaatcgcttgaactcaggaggcaaaggttgcagtgaaccaagactgcgccattgcactccggtctggggaacagagccagactcagtctcaaaaaaagaaagaaagtaacaattttagtttttaacataaaacttgggcagttttatttttgtcttctataaaaatacctcacattgaatcagtgaatttagtgtgtatttcttcctcaaaggataaaaatcatatctgttacttagatgtgaatttgaatgtcttgttttaagctgtgagattttcatgttttttagatgtgcttaatttttaggtgttaaatgaatatttttgtgtaagcttctaattgcacaaatacatatattcctgtgtgttttcgtaggtgaaggtgataaagtaaagtgctttcactgtggaggagggctaactgattggaagcccagtgaagacccttgggaacaacatgctaaatggtatccagggtaagatatttaattgttcattgtacaggcaagttggatagcatgcagtgggagacttgaattactttttacctcaactatttttgccttcactatggcttgaaattcatgctaggtttataaaaatgagcaaggtttataagccttctctgatgaccaaaaacattcactgcttatgtgtgatatctataacattcagattatccctttttttttttgagacgaagtctcactctcttttgcaggctggagtgcagtggtgcaatcttggctcactgcaacctctgcctcccaggttcaagtgattcttgtgcctcagtctcctgagtagctgggattacaggcacccgccactgccaccatgcctggctaattttttttttttttttttgatatggagtctcactctgttgccaggctggagtgcagtggtgcgatcttggctcactgcaacctccgcctcccaggttcaagcgattctcctgcctcagcctcccgagtagctgggacaacaggcaagtgccaccacgcccagctaattttttgtatttttagtagaggcagggtttcaccatgttggccaggatggtcttgatctcctgaccttgtgatccgcccgcctcggcctcccaaagtgctgggattctggctaatttttgtattttttagtagagacagggtatcaccatgttggccaggttggtcttgaactcctgacctcaggtgatcggcccgcctcggcctcccaaagtgttggcattacaggtgtgagccactgcgcctggcctctagattatcccatttctttttttttttgagatagagttttgctcttgtcgcccatgctggagtgcaatggtgctatctcagttcactgcaatctccgcctcctgggttcaagtgattctcctgcctcagcctcctgagtagctgggattacaggtgcctgccaccacgcccagctaattttttatatttttagtagagacagggtttgaccatgttggtcaggctggtctcgaactcccaacctcaggtgatccacccacatcagcctcccaaagtgctgggattacaagcatgctccaccttgcttggcctctagattatccaatttttaaatacagattaggaaatgtgtgcttttttgttgttggaagtaggctcttttatgatcagcgtgagagcccatattgccaaggagattccttaagaagccatcatacccctaggaaatattaatgtatctcattatctctatgacatacagttgttcacatttttttttttttttttttttttttttttttttttttgagacggagtctcgctctgtcgcccaggctggagtgcagtggtgcgatctcggctcactgcaagctccgcctcccgggttcacgccattctcctgcctcagcctcccgagtagctgggactacaggcgcccgctaccacgcccggctaattttttgtatttttactagagacggggtttcaccgtgttagccaggatggtctcgatctcctgacctcgtgatccgcccgcctcggcctcccaaagtgctgggattacaggcgtgagccaccgcgcccggcccagttgttcacattttaagatctctggttggagtgtggtggctcgtgcctgtaatctcagcactttgggaggctgaggcgggtggattgctggagcccaagagtttgagaccagcctgggcaacatagtaagaccctgtctctacaaaaaatacaaaaaaaaaaattagccagtcatgatggcacacacctgtagttccagttactcatgaggctgaggtaagaggatcacttgagctggggaggcagaggttgtggtgagctgatgccactgcactcggcgccactgcactccagcctgggcgacagagtgagacactgtctcaaaaaaaaaaaaaaaaaactagccgggcatggtggcttacgcctgtaatcccagcacttcgggaggctgaggcagggagatcacttcaggtgaggagtttgagaccagcctgaccaacatggtgaaaccctgtctctactaaaaatacaaaattagccgggcgtagtggtgcatgcctgtaatcccagctactcaggaggctaaggcaggagaatcgcttgaacccggaaggctaatgttgcagtaagccaagatcgtgccactgcactccagcctgggtgacagagcgagactctgtctcaaaaaaaaaaaaaaataacaaaagtcaaggtgctaatttaataacttgttttagaaagttctcaagttgatattttttgctctactaatattagcataggtagcataacagagggaacttttttaaccttaaaatgacagtgggatagggaattgggtaacattttactttgtggctccttagaagtactgaaaagcaagttaatggaattaatagaattaatatgatggagattatatctttgcttatacttcactaatttatcagctactaaagtttaatcttttaattgtttaggtgcaaatatctgttagaacagaagggacaagaatatataaacaatattcatttaactcattcacttgaggagtgtctggtaagtctcatataatttatattttcaaattcacatttcaaattataatttatattttcattatgtagtttatattatatcatttgttttatagttatttcttcatgtgatattcacagtatagtattataaatcaatatatgtgtacattacatcaaaacacaaattttaagttaaaaacaaaataataaatgtatgatgggctttaaagatgagagctagctgggcagtgtttcacacctgtaattccaacattttgagaggccaaggtgagaggattgcttgagcccaggagtttgagatcagcctaggcaacatagtgagaccctgtctctacaaaaaattttaaaaaccaattagccagacttgtggtacatgcctgtagtcccagctacttgggcggctgaggcgggaggatcgcttgagcccagaaggtcagaggattcagtgagccaggttcattccactgtactccagcctgagtgagaaagggaaaccctatctcttaaaaaaaaaaaaaaaaaaaaagagagagcctaaaaagtgtttcttattctttacctgaagtaaatttgtcaaaagataatcaggatgaactgatttaagtatcattgtaggcaaaaatgggcttgaagaactaaaatattaaaagtcccttagccttctgaaattagatctttgtataatgtgctttgtactcataagtagttttaagtttttgcagacaatatttaaaatctcaaatatatctaaattgataggatgggcgctgggcacggtggctcacgcctgtaatcccagcactttgggaggccgaggcagatggatcacccaaggtcaggagttcgagaccagcttggccaacatgatgaaaccccgtctctactaaaaatacaaaaatttagctaggcgtaatggcgggcgcctgtaatctcagctactggggagactgaggcaggagaattgcttgaacctgggaggtggaggttgcagtgagctgagatcacgccactacactccagcctgggcaacaagtgtgacactccatctcaaaaataaataaattaaataaataaataaattgataggatgaattgaggtggccaaggcatcagtaataggtggaaagaaccctggactaaaatgggagactagagttgcccccagtgactctaccttgaagtcattcattctccctgggcctcagctttttgtttgtaaaatgaagggattagattagataatcttatgacttccttctagctccatcaggctatgcctcttgtgaatattcatatattgaattggaataaagccaatttattttaaatttatgattaatttcacttttcaaatggaaatgattgcctctaccaaaaataattctaacttacagttcctatttctgttacaggtaagaactactgagaaaacaccatcactaactagaagaattggtaaatatgcttgttaactatccttttaatttaactgccaatttatttatttatttatttatttagagacagagtctcactctgttgcccaggctggagtgcagtggtgcgatctcagctcactgcaatctctgcctcccgggttcaaccgattctcctgcctcaacctcccgagtagctgggactacaggcctgcgccaccatgcccggctaactttttatatttttagtagagacggagttttaccatattggccaggctggtctcaaactcctgatcttgtgatgcgcccgcctcggccttccaaagtgctgggattacaggcatgagccaccgcacccggcctttaactgccaatttattatagttgttatttatggggtggaaagataagcatgttcttccaaggtcaccatgatatatttatttcagatgacattactataaatttaagaatttaggcggccgggcgtggtagctcacgcctgtaatcccagccctttgggagaccgaggcaggccaatcacgaggtcaggagatcgagaccatcctggctaacatggtgaaaccccgtctctactaaaaatacaaaaaaaaaattagctggatgtggtggcgcacacctgtagtcccacgtacttgggaggctgaggcaggagaattgcctggcctgaacccaggaggtggaggttgcagtgagccgagatcatgccattgcactcaagcctggcgacagagcgagattccgtctcaaaaaacaaaaatgaaaaaaataatttaatgaagtacttataaattgcagtcagaggctgggtgcagtggctgacacctgtaatcccagcactttgggaggccgaggagctcaagaccatcctagccaacatggcgaaaccccatctctactaaaaatccaaaaattagccgggcgtgatggtgtgcgcctgtaattccagctactcgggaggccgaggcgggagaatcgcttgaacctgggcagtggagattgcagccagctgagatcgtgccagtgcactctagcctgggcaacagggcaagactccatctcaaaaagaaaataaaagaaaaaaaaatcagtcagacgtgtctgtattaaaaatgttagtaggccatcagatagtttttccaagttcaggaggaacactgataggttgcctcattgccatctctgctaaaatcacaagagaaagggtgaagtgtctttttgtacctggggttccttaagtaagccaaaattatttcagttttctactagtgtgccattaccctgataagccctaacccacctgcttctttatcccatactgtcattgtaccttccccagcttcttcacagaggtgtaagttttggtttgtttacctcctgttacctcatggagaagtagaggttttaaaactcaaaaagtgggcagagaaagatattatgctaagcaaggaaggtaattgttatccccacttttcagatgaagaaagagtcagagaggttaagtgacttgcgcacaatcacattacaaatagttagtggaactaggaccacaagcaaggtcttctgaatcctacatcacagggcagatctcattttcaacttaggcatatttcaaaagtagtagaaagtttaatttagaatatgtctagtgattccccacttcctaaactggtaccatcatctatttagtatcttaagaattacaagcggctgggtgtggtggctcacgcctataatcccagcactttgggaggccaaggcaggtggatcacctgaggtccagagttccagaccagcccggccaacatggtgaaactccgtctctactaaaaatacaaaattagctgagtgtggtgctgcacgcctgtaatcccagctacttgggaggctggggcaggagaattgcttgaacctgggaggcagaggttgcagtgagccaagaccacgccattgcactacaccctgggcaaaaaggagcaaaactctacctcaaaaaaaaaaagaaaaatacaaaaattaccagggcgtggtggcacacacctatagttccagctacttgggaggctgaggcataaaaatttcttgaacctggaaggcggaggtttctgtgagctgagatcatgctactgcactccagcctgggtgatggaccgagattctatctcaaacataaataagtaaataaataaataaataaataaataaataaataaataaaacataaattcagctccatgactgctcctgcagagcagggctacccactacgcagtgagtggcattactactatttaattgcagaacactatcattaccccaacaagaaactccatgctcacccatcaacagtcattctccattgcccaccctacccctaggccagggcaaccagtaatctactttctgtctctatggacttgcctattctggacatttaatgtaaatggaataatgtaatatgtgtcctcaaggtgtatccatgttgtagcatatatgagtacttcattcttttctattgtagaaaaagagtccattgtataaataataccacattttgtttatccatttgtcagttgacatttggcttgtttctactttttgactattatgaatgatggttctatgaacatttgtgcataagtttttgtatagacatgttatatacccagttctcttgggcatatatccagggatggaattgctgggtcatgtggttattctatatttaaccttttgataaactatcagacagatttccaaagtgactgcaccctttaacattcctaccagaagtgtatgaggatttcattttctctacattcattatctgtcttatttatcacagccattctagtggatgtgacatggtatctcattgtggttttgttttgcatttccctgatgattaatgatattgagcatcttttcatgtgcctattggccatttgtaaatctttgtagaaacgtctgttcatctcctttgacttttttttttttttttgagacggagtcttgctctgtcacctaggctggagtgcagtggtaagatcttggctgattgcaacctccgcctcctgggttcaagcgatcctcctgactcagcctccctagtagctaggattacaggtgctcaccaccatacctggctaatttttgtatttttagtagggacggggtttcgctatattagccaggctggtcttgaactcctgacctcaggtgatccacccacgttgggctcccaaagtgctgggattacaggtgtgagccaccatgcccgacccattttttattttttcttttttttgagacagggtcttgctcagtcacctgggctggagtgcaatagtacagtcatgctcactgtggcctcgacctccctggctcaagcaattctgctgcctcagtcttccgggtagctgggactacgggtgtgcgccaccacacccagttaatttttgtattttttatagagagaaggtttcgccattgttgccctggtggtctcgaacccctgggctcaaacaatctgcctcccttggcctcccaaagtgctgggattacaggtgtgatccactgtgcccagccttgaccattttttatttgggttgtcctttttctactgaacagtctagggggatgggttatctttttgttattgagttaaaagagatctttatatattacagttcttttttttggcttcttttactttctaaatgaagatgatagttatttatatataaaagttcctgtcagatttatgatttgcaagtattttctcccattctgtgggtttccttttttttttttttttcccaagacggagtcttgctctgttgcccagtctggattgcagaggcatgatctctgctcactgcaacctccgcctcccgggctcaagcaattctccttccttagcctccagagtagctgtgattacaggtgtgcaccaccatggctggctaattttttttgtatttttagtggagatggggtttcaccatgttggccaggcttgtctcaaactcctgacctcgtgatctgcccacctcagcctcccaaagtgctggaattacaggcgtgagccactgcacccggccacctttttcactttcttggtgttcttcgaagcataaacgtctttaatttttttttttttttttttttgagacggagttttgctcttgttgcccaggctggagtgcaatggtgccatctcagctcaccacaacctccgcctcccaggttcaagcaattctcctgcctctgcctccccagtagctgggattacaggcgtgcaccaccatgcctggctaattttgtatttttagtagagacggggtttctccatgttgaggctcgtctcgaactcctgacctcaggtgatccgcctgcctcggactcccaaagtgctgggattacaggcgtgagccaccgtgcccagcgaaacatctttaatttttatgacatccaatttatctatttttctgtgtgtgttgctcatgcttttaatgtcatatttaagaaaccattgcctaatccagggtcaccaaggtttatacctatgttttcttctaagagttttatggtgttatatcttacattctggtctttgatccattttgagttaatttttgtatatggtatcaggtaggggtccacgtcctttttgtttttagcaagttgagtttgagatacctgcaggacattgaagtaggaggataataaaaccttgtataaaggagagtaagatgttgctggtagggaaagtgtctggaaagactttttttttttttccggagacggagcctcgctctgtcacccaggctggagtgcagtagtgcgatcttggctcactgcaaccaccgactcccgggttcaagcgattctcctgcatcagcctccccagtagctgggactacaggcacatgccactgcgcccggctaatttttgtatttttagtagagacagggtttcgccatgttggccaggctggtcttgaactcctgacctcaggtgatccacctcagcctcccaaagtggtgggattacaggcgtgagccactgtgcccagctggaaagaccatttttcagaagggtcgatgagggaatggaagggagccaccaacatctaattaggtgggcacaagtaatggagcaacaaaacaaactgaaaataaaaacaagtcaaagataggagaagcaggaaagagcaatgtctagttgccctctggacatttccacctagaatgcatctctaaaaaccactcagactgaatctaatcctgcacttttttctcctgtattggttaatagtaccacagttcacaaggttgcccagtaatttatgttgttcctaagctctttgctctctgtaatccttttacatttaattaatcatcaaatttgatggattccacctttttaatgttgcttcagactttcccacttattctgctctagttcaggcccttccttgtttttcaactggacaattgtagtagtctcctaactggtcttttgtctgtattataacctgccaacagagtttttctttttgtttgtttgtttttgtttgttttgtttttttgtttttctgagacggagtctcgctccgtcaccgaggctggagtgcagtggcgcgatctcggctcaccgcaacctccacctccgggggtcacgccattctcctgcctcagcctcctgagtagccgggactacaggcgcccaccactatgcccgggtaatttttttttttattttttggtattttttgcagagacggggttttgaactcctaggctcaagcgatctgcccgtcttagcctcccgaaatgctgggactacagacgtgggccaccatgcccagccttatcttttatttttattttttaatatagatagggtcacactttgttgaccagggtggtttcaaactccaggcctcaaggaatcccccttggcctccccaaagtgctgggattacaggtgtgagccactgcacccagcctcctctctttcaaaaaacatttattgagctataatatacatacagtagccgggcgcagtggctcacgcctgtaatcccagcactttgggaagttgaggcaggtggatcacgaggtcaggagttcgagagcagcctggccaatatagtgaaaccccatctctactaaatatacaaaaaaattagccaggcgtggtggtgcatgcctgtaatcccagctactcgagaggctgaggcaagagaattgcttgaacctgggaggtggaggttgcagtgagccgagacgcgccattacactccggcctgggtgacagagcgagactacgtctcaaaaaaaaaaaaaaaaaaaaaaaaaatatatatatatatatatatatgattttatatatatatgattttatatatatatgattgtgtatatatatatgattttgtatatatatatgattttgtatatatatatgattttgtatatatatgattttgtatatatatatgattttgtatatatatacacacgcacacatacacacataaagtgcttaaagtaccctaatcgtaagttttctacttgatgaattttaacatatatatgttaaaatatatattaaatatgtgttaaatatatattaaaatgtatatgttaaaatatatatatttatctgtgtgactatcccccagattaagatatagaacattcccacaaccctagaaagttctttcatgctccttccccatcagtacccacccccaagttatattctggcttctattaccatagattaattttgtttattaccatagattagttttgaagttcttataaatggactcatgcagtaggtactcttttgtgtcataatgatgaattatgattatgttttgctcattatatctatgagatccatccatattgtctgtggcaatagttttttttttttttcttgctgtgtagcgtatgaatataccacaatttatgtatctgttcacctgatgatggacatttgagttgtttccagtttggggctattataaataacactactatgaatactcttgtgcatatctttggcagagatatacactcatttttaatacccaagagtggaattgatgagtcagagggtataagtgtcctctcctagcacttccctacacatgctgtgttcctactttaagtatcataaaaacaagtttccattgactttcttgctttattcagtcctacccgctctgctacagaaacgaagtttgagagctaggaaattgacacattcaaggttatagactgggacttccctgatttcccatcattttccccaaataattgctagtgactcagtaacaacatccactctttaagtaacttaggttaattgttaatgagtacagctagattcaaaacagttcagatttttgaagcacttaacctttttcttgcctattttaccttgcatcgtttcaaacactacaaaatacatactcattgcatttacaattaattgtaagattctgaaagtgatttttcagtgcctgaatacttcaaaaaatcttcccaaagcagctttgctttgctggtttgtttttattctttcgcttgctccttaattttttcattttaactatattttgctattgagttgtgataatgaaaataattgtttaaattctatgttctttttcctcaccaatttttatttcagatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaaggtatgcattgctgtttttaaaaagcaagaaagggccagatgtggtggctcatacctgtaatcccagcactttgggaggctgggacaggtggatatggacattttttaaacgtaaccttaatgctgtgtgttagtctgctcaagctgctataataaaattccatagactaggtgtcttaaacaacagacttatttctgacagttttggaggctccaaaatcaaggtgctggctgatttggttattgatgagggccctcttcctaccttgcagatggctgccttctcactgtgtcctcacatggcatgggttgggattggatgggacaagatggagcaagtactctggtctcttttcctctacttttaggaacactaatcccatcatgggggggtctcatcttcatgacctcatctaaacctaattacttcccaaaggcctcatttccaaatatcattacattaatcatggaaaaaagattaaaaatatgagttctaccagcctggacaacataatgaaactgtctctacaaaaaatacaaaaattagccgggcatggtggtgtgtgcctgtagtcccagctccttgggaggctgagcggggaagatcacctgagccagggaggtcaaggctgcagtgagccatgatcatgccactacacttcggcctgggcaactgagcaagatcttgtctcaaaatatatgtatctctcctttaaggatgatggacactgtagtgcttgccaacaacatcgaaggttaaagaagaagtttcaaactgagtacacttttgggtactttacctgtaatagttctctaagctcttgaccatcctccctccaaaaagatgagaattctcctactgctaaaaaaacttaaacgtttacttatttttgacgcatttaagatccttttgatctttaagatatttcaagtgcttttgaaacactattcagataatcgtataagttatgaaacagtatgaacattaatgatatttaaaattatattcattgatgtaagaatcaatggaaagcttccaattttttccttatagatgcatttatttaaaacttacacaagctccacttatcttggtggtggtaaaataaaccctttaattgtcatctttctttctttttttaattttttatttgttttaagacggagtctcactctgtcgcccaggctggagtgcaatggcacgatcttggctcactgcaacctccgcctccccagctcaagcgattctcctgcctcaccctcccgagtagctggaattacaggcatgtgccaccacgcccggctaattttttgtattttcagtagagacagggtttcgccaagttggccgggctggaatttttctactataacagaaacacaagcaattgtgtcatttttttcctgcatcttaaacacgcgcttaattgtttggccataaattgttagttttcaaaccttaatgtatctgcagcagaagggtttagcaggttgtaataggaagagatcaagagactgtgcattagggagagtgtcttttctctatctaacaggagtcaatgggcgctcatattatcactgagactacaaactaggatggtgtgggaaggagagcctaagggttggaattcatttgaactctcctcagtctcactaaattgagaggcaagtaattgatacaggctctctactcatgctgggactgctgcctatttgtcttcccaaaagctgatgaggaaagactggcactaagaatcttttaattttatataaaataaggatggggctaactgaagtgaagcaggtgagggttattagagaaaatataacattgtcacttactgagaaatcctagatttagtgctaaacttttttgccaatggctgtgtaacagagaatgccctagtaaaaggtcttgtaaaaatagtaccgaatcagtatctttttttctttctttgaaaaaattatgtagtgtaagataaagccctttatttagtatatgtactaaagtacttattttaatctttatgtgtatatatattactgtatataatataaaaatcaaataacccatattcatttcttatctgtctttccatatgaatctgctctaatagtaaaatgaataacatcagtttattctagaagaggttttaaataattacaaatattagcaaataacatcaaaagttatctagcctttattgctcatgtgccagtaaccttctgacctagaagagggctttgtggggaggagaaggggaaaggcgctgtagagaagtatgtagaatccagtagttacctttaagccaagagggaagtaattgccagtggtaaactactggtctgaggggaaaagatctatgcccagaatatcaccatctcaagttagtggctttatacaaggatgaaataatatagaaaaaaatgagatgatatggtatcacaaacaatcagaaccaaaggaaccttaaagattattttataattttttttttttttttttttttttggagacggagtttcacttttgttgcccaggctggaatgcaatggtgcaatcttggctcactgcaacctccacctcccgggttcaagcaattctcctgcctcagcctcctgagtagctgggattataggcatgtgccaccacaccctgttaattttgtatttttagtagagacggggtttctccatgttggtcaggccggtctccaacttccaacctcaggtgatctgcccgcctcggcctcataaagtgctgggattacaggcatgaaccactgcacccagcccattttataacttttatgaccttaattgggaacctgaagtacagatgggctgttgcctaggatcacgccgatagttgggaatagaattcagatttcctgacttctggtccagtgttttggggtttgtttcagtttttttttttgttttgttttttgttttttttagattttaaaaaattgtgataaaatacacatacagtttaccatcttaaccatttttagtgtatggttccgtagtgttaagtacatttacattgttgcacagtcaacctccagaactcttcatcttgcaaaaccgaaactctacatccattaaacagccaggcgtggtggcacacgcctgtagttccagctgcttgggaggctgaggcaggaggattgcttgagaccaggagctcaaggctgcaatgagctgtgattgcaccactgctctccagcctgggatacagagcaagaccctatctttaaaaaataataataataataaaaacatgttcattaaacaactccccattccctctcttcccaacccctggcaactaccattttactttttgtctctataaatttgactactctaggtgtcagtattgttgttgctttgtttgtttgtttgtttcttcctttttgtggagaacggggtctcactatattgctcaggcaggtctcgaactcctgggctcaagctatcctcccgcctctgcctccctgagagctgggattataggcgtgagccaccgcgcccagcctgtttgtttgtttttaactcgttgtagcattacatctaaaagtaatgtggaaattacttgttctccttttgatttttttggcatgaaatacacacttcattctgactttttttggtgttgatgctttcttataatataaatcagcttatagtgccgtttctttacttgtattttttcctctgccttgagtacgttttctctatctgtatacctagtcccattccccactctacccccaactccctgaatctactttgtgaactcatgtttcaaggttcagctcagaagtcacttctttcaagttttctcccgcacccacagcagagttaggagctccttcttatctactcctggtgctggtagagttttgttttgttttattttgttttgttttgtttttcttgagacagggtctcgctctgtcgcccaggctggagtgcagtggcacacaatctcagctcactgcaacctctatctctcaggttcaagcgattctgctgcctcagcctcccgagtagctgggattacaggcatgcgccaccacacccagctaattttttttgtgtgtatttttagtagagatggggtttcaccatgttggccaggctagtcttgaactcctgacctcaaatgatctgcccgcctcagcctcccaaagtgctgggattacaggcgtgagccaccaggcctggctgagcattttgctttttacactattttgggactggtttctgccctgcccattagaccaagcttcttaagggtaagtgctttatcttcttatctctgatgcattccatgtttgagcctatagtttttattatgcccaagagggtactttttaagaagaaagagattaaacaatcctttcctctaccccctagccagagaaacctttctgagacatagatgtgatcatatctgtctctagtttaaaacccttcactgcctcccaggacccttgggatcaagtccaaactcctttacgtggctcgcctaatctttcatgatcaggcacccttttgtagcctcatctcatgctattttctcaaattctgtgcccaagctttgcctgtgcacttgtaggccacgttctgtctctctccttggagcttgtttatgctgtttcctttgcctaaaacacttttctcccattgcccttatcccccaaggcctccttctcctagtaaactcctaattcattcttttgtacccagttttaggtataatttcctccaggaggccttcgtttatgcatgcatgcacacacacgcacacacacccttcctgtgctcttcataacacattgtaattacctttgtcatcataccatttatactttcctgtttgcttgtgttctttacttgtctatgaactattgggggcctgaggtttatgtatttgttaattgtatccctagtacctagaacctagttaagtgtccagtaagtatttcttgaataaactattgttttccaaacatgttttcagaatagtgttcagcaggatgttaaaaggatgccatgaaaaaggaaccccatagttaaatagggaaatgccttgtacatttctaagagggaacatagactatactgtcctatattgtactgtactgccctgtcctggatgacagtggttctcaaacgccagtgtgcccaaccccagaaattttagattctgtgaatggagcccagaaatccgtggtttaaaaatgccccaggttattctcatgtgaggccatatttggaaaccactggtacataatgattataaagatgctaaaataaataaatagttgtgatcacaaaggtatagttaaaatatgtaatgcatttggaatagtgcctagcacgtactatttatgcaatattactggtaactgctgctgctgttgtcattattgttatatgtgaccatgaaacacatgttttgtggcatatttattcacatttcacaaaactattttgggaaaggctgaattaagcaagtacttcagtgccacctatatgctgatgacatccagatctctatctctagccctgacttctcctgacctcaagatttgactcttcagttgcctactggttatttttatatgggtgtcctgaaaacacctcaaaaatatctgaagatcccaaacctgtacctccttttatatttcttattggcatcaccatatccttgtcagccaagctagcaatcttgtaatcaactttagtttgtctttcttcttcagccctcatatccagtcagtcacccaatcctacttgtcccacttcagaagtgtccctcaaatccatccctctatttctggaattagtcgtgacctttccatatgctgctccttttacctaacccttgtttttctgcctggcaaatgactgtccatgcttaaatgtcactcctccacttccctcctcccccgatccagccactgccaacctgtgaagccttctccaactagcctgagcagaagaacttgttttctcatcttgtcccagagcactttgtacataactttattatagcacttatcactttgtactttgtgcttaacctcctagcctcatcttacatcctctcccactagcgtgtgagctatttaagagcagatgccacgggtgagtcatcctcatatctcccggcacttgttgggtgcttggcacgtagtaggggctcaataaatgttttcaatgaatttaaacaactaagagagtctaaaactagcataattattttctctttttgcagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcata

SEQ ID NO: 2165 - DNA, 53813 bp, Homo sapiens
gctggggccaagccgcagagcggagttggcatttccagattggggctcgggccgcgcctcctccgggaccctccccttggaccgagccgatcgccgcggggcagttcgggccggctgtcctggcgcggtgggtacagcttgtgtaggctttcccctcccccgctttccctccttcccctctcctccctcccctcttcttttcccctccacttccctcgggccggcgctgctggggagggcgggaaggccgcgccagcccatcaggggtggcccggccccggctgcttgcccgggttcctcggactgccgacggcaggcgtgggtgggtgggtgacttcaggcctgcaggattgccttcctaaaccctgtgacacctaaggtaaattgaggcaaagaactttttaaaaaaatatgatcaaagggatttcctccccatgtgataacctgtggcttgtgtggagcagggtggagtgtgtctggagagggcatatgaaactgaaagaataagggccaaagagcttccggaagaggaaattagctggtgattctttccaatctgctttcccagtcacctttccggcatgttctgtaaaacaaaatgtaatttgactttgtttcattattttaactccataacacttaaattgttttcttttcggggaggggagtgtttattctcaaactaagcagtagccctctccaccttcgaaaaaggaacaacgtcaatccaacctttgttaaaaaactccaacctatcagattttaataatctagtagtttgctttcaaatataattatgtcgctagttctgtcacaactatactttgatagtttaatgactcacagaaatttgtaagactggaggttgcagtagtgtttctttcttattcttttttttccccataatatttattatagtcaatgaacagtgttacagacggccatcttagaattataacattttagagttggaagggatcttagtcaaaccctgtccttttacaaaaccagaaaccacggcttaggaagatttcatagcttgctaaaggctatccaactagttagattagaacccatgttatctggcttcttgcccaccactcttactgcgcaattgctccatatcgcctccaagcatgaaaattaaatgtattcaattcaacacacatttctgaagagtataatactttgtaccagtgactgtggtaccactttctatgtatttcaatgtatttaacatgcttatggagtacttgagattcccccccacccccacattcaagaagtggcaacagtttagatttatacacacaccttcacatgtacgtgtgtatacttgcatttgctcagatagtttcttgaaggatacacaataaaaatgttaatagtaatgacttatggaggagaagagagatagaagactttttactttgtacttcacatgatctaatgtacggtttgaatttgttataaattcgtattgatttcataattgaaaagttttaaagttcacaccttcccacacaaatatatatatcaacataagcaagtatataccaatggtatgtacacatttatgtgcatatatgtatttatacatatcagtggtttgtactgtaaaatccggtatgattcaggtcaactcagctgacaaagcagacctcattattggatactcatgtttcgttttcttgtattgctctctcctaatgtaagatagtaaaaataatatgttactagtcgtcatatatttttagaaattgtcctaagcttcttgattatcaaataatgtagcaaacttttaacacatttaaaatatcaaatctgggtacttgcttcagtggtagcacatatactaaaattcgaacaattcaaagaagattagcatggtgtttttttttatcaattaattaattaatttttttttttgagacggagtcttactctgtcatccaggctggagtgcagtggccctatcttgactcactgcagcctccgcctcctgggttcaagctactcagcctccccagtagctaggactacaggcatgcgccaccacgcctggctaatttttgtatttttagtagacaccgggtttccccatgttggccaggctgatctcgaactcctgacctcaggtgatgcacccgcctcggcctcccaaagtgctgggattaaaggtatgagccacctcgcctggccagtccattttttttttttttgagacagagtttcgcttttgtttcccaggctggagtgcaatggcaccatctcagctcactgcaacctccgcctcccaggttcaagtgattcttctgcctcagcctcccaagtagctgggattacaggtgcccaccaccacacctggctaattaggtcccttttttttaataaaccacaagaaaaatttgacacctgacgctgtggctcatgtctgtaatcccagcactttgggacgccaaggcgggcagatcacctgaggtcaggagttggagtccagactggccaacatggtgaaaccccacctctactaaaaaaactagccgggtgtggtggcgtgcacctgtagtaccagctacatgggaggctgaagcaggagaactgcttgaacccaggaggcagaggctgcagtgagccgagattgcaccactgtactccagcctgggtgacaacagtgcacctttgtcccgaaaaaaaaaaaaattgacacaaggaaaatatctgcagcctgggcaacatggcgcagccctctctctaataaaaatacaaaaattagccgggcgtgctggcttgtgcctgtagtcctagctactttggggagctgaggcaggaggatcacctgagccttgggaggtggaggctgcagtgagccatgattgggccactgtactccagcctgggcgaaagagtgagaccctgtctcaaacaaaacaaagaaacaaaaatctgaattgtagactctttgtagataagaacatattttttaaaaaagttaagactagggccaagtgcggtggctttcacctgtaatcccagcactttgggaggctgaggtgggcggatcacctgaggtcaggagttcaagaccagcctggctaacatggtgaaaccccatctctactaaaaatacaaaaattagctgggtgtggcggtacacccctgtagtcccagctacttgggaggctgaggcaggagaaccacttgagcccatgaggcggaggttgccgtgagctgagaacgcaacattcaactccagcctgggccacagagtgagactccacctcaaaaacaaataaaaagttaagactaaaacagtttatagtgattaggagttcagctgtctagttttgtttttgttttgagatggagtttcactcttgttgcccaggctggagtgcaatggtgcgatctcggctcacctcaacctctgcctcccaggttcaagcagtttcctgcctcagcctcccgagtagctgggattacaggcatgcgccaccacgcccggctaattttgtattttcagtggagacggggtttctccatgttggtcaggctggtctcaaactcccgacctcaggtgaaaaagtgctgggacctcaggtgaaaaagtgagtcactgcacctggcccagctgtctcgtttttagaaatagattaagactcaaaaaaaatattgcccaccgtaatatatctgattattagcaaagcttggactagagtctaggttctagtctagtggcccttgtactatacctgtaattttattgctttctagtgcattggatgattccaactaggctgacaaagtaataatatctaaaggttagccaggaccatttcaatagttaagaattattatttttttctttggtttttattttattttgtcttccttttttttttcattttcaggaagtgagcagtttctcaaaattattataattaatggaccagctaatttgtatagtgcttaaaatattttagtaacataaattttactaaataaatttactaatttagtaaataaatgttctccttttatttcattgtaaacattaatttctttagtaaatcctgtatttatattgtaaatgtttagcgataaaataatgatatttcactgtttttgtttggtctaatatttaagtctggtaggtagtattagcagagagcaaaacctacagtttatgaaataaacattcattgagcacttaatgtgttccaggcattcattgtagtatgtggtaggattccaaggataaatatggcaaaacaaatgcctttcttctgttttttttttttttttttttttttttgagacgacggagtctggctctgttgcccaggctggagtgcagtagcgcgatcttggctcactgcaggcactgcctcccggcttcacgccattctcctgcctcagcctctcaagtagctgggactacaggcacccgccaccacacccggcttagagtgtgtgtgtgtgtgtgtgtgtgtgtgtgtgtgtgtgtgtgtgtgttttagtaaagacagggtgtcaccgtgtgtgtgtgtgttttagtaaagacagggtttcaccatgttagccaggatggtcgcattctcgtgtgtgtgtgtgtgtgtgtgtgtgtgtgtgtgtgtgtgtgtgtgtgtgttttagtaaagacagggtttcaccgtgtgtgtgtgtgtgtgtgttttagtaaagacagggtttcaccatgttagccaggatggtcgcattctcctgacctcgtgatctgcctgcgttggcctcctaaagtgctgggattacaggcgcgagccatcacaccaggccgcctttcttcttttttttttttttttgcttttttatgttcgtctgtttttattttgcttttgtgtgtttgtttgtttttccattgttcttttgaggctgggagattatcatgagctgtcaattctcaagctttatctctgtgagataatctggtaatagttttataaaatgtaacctgttagcactattaaaggacattgtgtgagtagatatgaagagacaaacagtagtgataagataaaaaatactttagaatttaacaaatactgtttctgtatcttagaggtcatgtgctacagtgtttggaaagagccctacgttgggtaccacagtacaggttattgactttgtttccaattagctgtgggattgtgcatgtcaatgaccccatctttctttacatgttcacatttttgatatgttattttaggtgttgaattcaaaacataaaaagggtattttaaggccgggcgtggtggctcacgcctgtaatcccagcactttgggagactgaggcgggcggatcacgaggtcaggagatctagaccatcctggcacccctctctgctaaaaaaaaaaaaaaatacaaaaaattagctgggcgtggtggcaggcgcctgtagtcccagctacttgggaggctgaggcaggagaatggtgtgaacccgggaggcggaccttgcagtgagccgagattgcgccactgcactccagcctgagctacagagcgagactccgactcaaaaaaaataaaagggtattttgaatattttattttatttatttgtttttgagacattgtcttgctgtgtcacccaggctggagttcagtgcatgatcccagctcactgcaacctccacctcctgggttcaagtaattctggtgactcagcctcccaagtagctgggattacaggcgtgtgctaccacacctggctaatttttttttttttggtatctctttttttcccctcggagacagagtcttgctctgtcgcccagagctggagtgcaatggctgcgatctctgttcactgcagactccgcctcctgggttcaggcaattctcctgcctcagcctcccgagtagctgggattacaggcgcacgccaccacaactggctaatttttgtatttttagtagagacggggtttcaccatgttaaccaggttggcctcgaactcctgacctcgtgatccacccacctcagcctcccaaagtgctgggattacaggtgtgagccaccacacccagccttttttgtattttaagtagagacaggatttcaccatgttgcccaggctggtcttgaactcctgacctcatgtgatctgcccgccttggcctcccaaagtgccaggattacaggcatgagccactgtgccggcctttgagtattttaagttataaaagaaatatgtgtttctatatatattatataatatatattatacatgatatataatatatatgatataaattatattatatacaatatattatatatgattaatatataatatatgatatatcatatataatatcaaaatatataatatgtatataataatgtatgatatatataatatagtatataatatattacatgtataatatattatatataatatataatacaatatatgtaaaatatatataatatataacacaatataatatgtaaaatatattacatatataatatatatatttttcagacagagtctagctctgtcacccaggctggagtgcagtggtgagatcttggctcactgaacctccgcctcccaggttcaagcgattcttctgcctcagcctcccaagtagctgggactacaggtgtgctaccacacctggcttattttattttatgtatttatttatttttctgagacggagtcttgctcctgacctcatgtgatctgcccgcctcggcctcccaatgtgctgggattccaggcatgaaccaccgtgcctggccagagatatgtgtttattatagaaaatttatgaaatagaataatgacgatcatattgtctacaggttgttttaatccccccccccccttcaacattctatagttaacatttctgtttttttttttgagacggagtctcgctctgtcgcccaggctggagtgcagtggtgcgatctcagctcactgcaacctccgcctcctgggttcatgccattctcctacctcagcctctctaagtagctgggactacaggtgcccgccaccacgcctggctaatgtttttgtatttttagtagagacggggtttcaccatggtctccatctcctgacctcgtgattagcccgcctcagcctcccaaagtgctgggattacaagtgtgagccactgcgcccagcagtcttttttttttttttggtttggtttggttttttagacagagtctcactctgtcccccaggctggagtgcagtggcacaatctcagctcactgcatctccgcctcctgggttcaagtgattctcctgcctgagcctcctgagtagctaggattatagacatgtgctaccacgcccggctaatttttgtatttttagtggaggcatggtttccccatgttggccaggctagtcttgaactcctgaccttgtgatccgcccgccttggcctcccaaagtattgggattacaggtgtgagcccccgtacctggcctttttttttttttttttttgagacggagttttgctcatgttgcccaggctggagcgcattggtgcaatctcagctcactgcaacctctgcctcctgggtttaagtgattctcctgcctcagcctcccaagtagctgggattacaggcgcacgcacaaccatgcccagttaatttttctatttttagtagagatagtgttttaccatgttggccaggctggtctcgaactcctgacctcaggtcatccacctgccttggcctcccaaagtcctgggattacaggcatgagccactgcgcccagcctgaagtctttcaaaatacattttttatttatccagtgtattattttatactgcactttcttcatctgtaaagtaacagggtcaggcatggtgactcatacctgtaagcccagcactttgggaggctgaggtgggaggattgtttgagaccagcctgggcaacatcgtgagaccccgtctctaccaataataaaaaaattagctggatgtgatggcacgcgcctgtgaagatcgcttgagcccgggaggtcaaggtggcagtgagccatgagggcaccactgcattctagcctgagtgacaagagtgaggccctgtctcaaaacaaacaaacaagcaaacaaacaaacaaaaaacccagggtggctgggcttaaggactagttgattccaacgattcaaaacccattataatagtttttaagcctgattatctgagattttgtcaaggaaaaaaattccacataacaatcccaggccaggcatggtggctcatgcctttaatcccagcactttgggaggccaagtcagggagatcccttgagtccaggagttcaagaccagcctgggcaacatggtaaaatgctatctctactaaaaatagaaaaattaactgggcatggttgtgcgtgcacctgtaatcccagctactctggaggctgaggtgggaggatcacttgagcccaggaggtggaggttgcagtgagtcaagatcagggcaccccattccagcttgggggacagagcaagaccctatctcaaaaaacaaaaacaggaatttgaggccaaatttatggattatatattttatctgctctgtatgtggttaataataggttatcctttatatgataaaaacatacttatgtccattttgcaggacttggcatgggcttttattgttttaaattgtgatacatttgtagctctgctgtttgatacattttgggatttgattttggtatgatttggtacccagtctttgttatggatacatgtgattcaccttgttatgatatagttttatgtattttcgaggatatgggtcatagtgaaaagtcacgtttacctgtacagactgagaatagcttgatctcagatggtcagatgttgaaccaagtggattaaagctgatttcttaaaccggacaaggctgctgccattgtgcattccctggtacttataaaatattatggtttgaaattttattcttatttctgtaatcatcttattcaccttaaatacagaaatacagacatctggctgggcgcagtggctcacacctgaaatcccagcactttgggtggccgaggcaggtggatcacttgaggtcaggagttcaagaccagcctgaccaacagagcaaaaccccatctctactaaaaaaatacaaaaaaaaaaaaaaaaaaaaaagctgggtcatgcctctgcaatcccagctacttaggaggctgaggcaggaaaattacttgagcctgggaggtggaggttgcagtgagctgagatcatgccactgtactccagcctggatgacagagtgagactccatctcaaaaataaagaaaagaaaaaaaaaacacagacatctcagcatatattaccatgtgacttaacctttctatggttctagctaattttttaggccttgaaagggaaggaagcctaacattttctgctacctcattggactgtcccttctgccagtaatccttgtagtaatttccttagacctatattggtcataatcactgggtgcatgacctttgatgagtaacagtcagaactactgtttcctcatatttcagatgaggcctatgatatattatgtaggttaaattagattccatatatgaaaacattctaaattgtaaagcacattacatatgttagttattatcaaaggtaacatcgtgaaagaagagaagatgagctatagaatcacacaagcccatgcttaaattttgaccttacattaaaccaaagaggattgatttttttttttaattgagacggagtctcgctctgtcgctcaggctggagtgcagtggcgcaatctcagctcactgcaacctctgccgcccaggttcaagcgattctcgtgcctcagcctccttagtagctgggactacaggcacgcgccaccacgcccagctaatttttttgtatttttagtagagacagggttttgccattttggcgaggctggtctcgaactcctgacctcaggtggtctgcccacctcaacctcccaaagtgctgggattacaggcttaagccaccatgcccagccaagattgaaaatttttagtttaaattcagcatgtttagtagagaagtacttacttgtagctaaaatgatgggatgaaggaaaatgaaaattagtttgtagatagtatttgggtacatgcggacactcatgaaatatgttgtatcgtttaaatttggtttgtagcacagtttcctttactttgtgtcatttaaaaaaattaaaacctagacagaagagaaacgtactaaatgtttgaatatagatagcactgtggctttcagatagagttaaatatttttactgaagaaagagaaaagatgtgggctcttatccataacttgtttgatcagcctgggcaatatagtgagaccttgtctctacaaaaaaaaatttaaaaattagctgagtgtgctgtcgcctgcctggagtccagctcctcaggaggctgaggtggtaggattgcttgaaaccgcaaggcaggggttgcagtgagccaagattgtgacactgcactccagtctgggcgatagagcaagaccctgtcccagaagaaaaaaaaaagttgtttaagtacttgcttgagatcctaacatgatcatggaatagaatacttcactctgaggtgagaagatcacttgaggccaggagttcaagaccagcttgagcaacatagtaagaccccatctctttttgtgtgtgcgtgtgtgtgtgtgagggagtcggagtttcactctgtcagccaggctgctggagtacattggcacgatctgggctcaatgcaacctccgcctcccaggttcaagtgattctcctgcctcagcctaccgggtagctgggattacaggcatatgccaccatgcccagctaatttttgtatttttagtaggggccgggtttcaccatgttggccagggtggtctcgaactcctgaccaagtgatccacccacctcagcctcccaaagtgctgggattacaggtgtgagccaccacacctggccatgagccaccaagcctggtcgagaccccatctcttaaagaaaaaaaaaagaatacttcgttctgagaaatgtctaggggtaggtattacctgcttatgaagtcatccatggcatttctggaaccatctgattgtatgaactgctttctaatcactctgtcagaataagttatctggacaaagtatcagagtacagtaagttccggttccatgccactaatcagctctatggccttagtcaaatcatttaccttccttatgttttagtttctttttctttctttttttttttttgagacaggatctggttctatcagcccaggctggagtggccaggctcaagtgatcctcccacctcatcctcccgagtagctgggactacaggctccagccaccatgccttagttttttggggttttttttgtttttttgttttttttagtgactgggtctacctatgtttcccaagtggattagtttctttttctgtaaagtaagagaatgatttttattatcctgtccagcaagacatagttattatgaacaatttttgctcgtgagtgtctacaaaatataataatggccgggtgcggtggctcatgcctgtaatcctagcactttgggagaatgaggcgggaggatcacgaggtcaggagatcgagaccatcttggccaacatggtgaaaccccatctctactaaaaatacaaaaattagctgggtatggtggcacgtgcctgtaatcccagctactctggaggctaaggcacgagaattgcttgaacccaggaggcggaggttgcagtgagccgagattgtgccactgcactccagcctggtgacagagcgagactccatctcatagtaataataataatgatgatgctttttagtatacttgattctgagctgctcgttttgttaaaattattttagggaagtttttgcccaaagttcgcggatacttctttcttcttaccaggccccaaagtcattgtaaatttttacaaggcagtggatgaacagttcataactccaaagatagatatcactcagaaaaatttttccacaagaagtccttttttttttttcgtcctttttttttttggcacactagtgtctcacttagcaagtccttttattttcaactcaagttaacaataagttggccgggtgtggtggctcacgcctgtaatcccagcactttgtgaggctgaggcgggcagatcacctgaagtcagaagttttgagaacagtctggccaacatgacgaaaccccgtctctactaaaaatacaaaaattagtcgggcatggtggcgcgcccctgtagtcttgctactcaagaggctaaggcaggagaatcacttgaatttgggagatggaggttgcagtgagccgagatcacgccactgcactctagcctgggtgacagagcaagactccatcacaaaaaaagaaacccaataagtagcaatcaggtatcacctgtgtttctcagcccttctcttctgctgctggtttactgccactcaagcagtggaccaaaaggcatttgtttctggccaaccaccatggacatgatctgatgactgcttttatctctgggacttgacctgtatccctctctctctcttttttttggatagcttttcattctgtctcccagggtacagtgcactggcacaatcatagctcactgcagactctgcttcccaggctcaggcagtccttccacctcagcttcctgagtagctgggactacaggcatgtgcaaccatgcccgactaatttttaattttttttttttttgagacgaaatttcgctgttgttgcccaggctggagtgcaatggcgcaatctcggctcaccgcaacctcggcctcccaggttcaagtgattctcttgcctcagccttcctgagtagctgggattacaggcatgcgccagcacgcccggctaattttgtatttttactagagacggggtttcttcatgttggtcaggctggtctcgaactcctgacctcagatgatcctcccgcctcggcctcccaaagtgctgggattacaggcgtgagccaccacacctggcctaatttttattttatttttttttgtagagatggggtctcaccatgttgcccaggctggcctcaaacacctgggctcaagcagtcctcctgccttgacctcccaaagtgctgggaatacaggcatgaaccaccatgtctggccctctctctctctcttttttgaaacctgatgatcgccaggcacggtggctcacgcctgtaatcccagcactttgggaggccaaggcgagcagatcacttgagatgaggagtttgagaccagcctggccaacatgatgaaacgctgtctctactaaaaatacaaaaatcagccaggcgtcgtggcggcacacacctgtaatcccagcactttgggagtctgaggcaggtggatcacttgaggtgaggagtttcgagcccagcctgaccaacatggtgaaaccacatctctactaaaaatagaaaaaaaaaaaattagctgggcctggtagcacacgcctgtaatcccagctacttgggaagctgaggcagaagaattgcttgaacctggaaggtggaggttgcagtgagcccaaattgcgccactgcactccagcctgggcgacacagcaagagtccgtctgaaaaaaaaaaaaaaaaacctggtgggttgctcagaggcagttacctatgtaacaagctggcagaaattctcaggataggcaaaaagataagaaccaaagaacatatccttccctttctaagtcataaaaattacttcctgtgaatgaaaagccaaaactttgcattaccaggccttgctattgatagtttacttggccagtgtattcacagagggaggaagcattgtcacatggcaaataaccagattacacccatagtctggttggcaggattgtacaagggtgcctgactaatcaagagtccacctgcttatttcttttcattagaatctaatatatttgctgtatagaatttagaaagttaagaaaagcgcaaagaaaataatctcactgctcagagataaccacagcagaattttgatatgtaatttagcctgtctttatatatctgtattttttataatttgggttatataatacaacatcattttgtaaccagctttttccacttaatacaacatcatggtgctcgctttggcagtacatatactaaaattggaatgatacagagaaggttaacatggcccctgtataatatatgcatgtttttaaaatacatcctgaacatgaatttttaatggttacctggtggcccatattaccatagtattgtcctcttttgttagatattgaattgtttttagtaaatagcactttatggaacatccttatatatacactcataatgaaatgatgggggattttttttttttttttttgagatggagtctccctctgttgcccaggcttgaatgcagtggcgcaatcttggctcactgcaacctccacctcccgaattcaaacaattctcctgcctcagtctcctgagtagctgggactacaggtgtgtgccaccacccccagctaattcttgtattttttttttttttttttttttttgtggagcctaggttttgccatgttggccaggctggtcttgaattcctgacctcaagtgatccacccaccttagcccccaaagtgctgggattacaggcatgagccactgcgcctggctgatcagggatttatttttttttttttttgagatggagtttccctcttgtttcccaggctggagtacgatggcacaatctcagcttactgcaacctctgcctcccaggttcaagtgattctcctgcctcagcgtcccgagtagctgggattacaggcgtgcaccaccatgcctggctaattttttgtatttttagtagagacggggtttcaccatggccaggctggtcttgaactcctgacctcaggtgatccgcctgccttggcctcctagaatactgggattacaggcgtgagccaccgcgcccggcctgatcagggatttatttatttttatttttttgagaatatgtttagaactagaatggatggttcaagagataatcatatatttaagacttttagaacatatattgccagattaccttccagaaaagatgtaccagtttttagttctaacaggcaaatgcctcttgcttcatactctccagccactgcgttttcgttgttggtagtaatgttgacctttgccaaataggataaaaatgttatcttttaaagtgtttatttctttgattattaatgaggtttaacattgttgcatatgtttgttgaccattaatatttcccacttgtaaatttgcctgttttctatcaacgtattaatctttttcttatagattttttttttttttgagacggagtctcgctgtgtcgcccaggctggagtacagtggcaccatctcggttcactgcaacctctgcctcccaggttcaagcgattcccctgcctcagcctcccgagtagctgggattacaggcatgtgccaccacgcctgactaatttttgtatttttagtagagacggtgtttcaccatgttggccaggctggtcttgaactcccgaaatcaagcgatccacccacctcggcctcccaaagtgttgggattacaggtgtgagccactgcacccagccttcttatagatttataagtgtattcatactactttttttgttttttaagacagtgtcttgacctgttgtataggctgaagtgcagtgacgcagtcacagctcactgtaacctggaattccttggcctacattgcccagtctggtcttaaattcctgggctgaagtgattctcccgccttaacctcccaaagtgttgggattacaggggtgagccaccgcatgtgacctcatgctgctttttttttttttccaactactttagtcagatgcttcttgagactattactagtcaaaaacaagatagattaaatggaggtagtgacaggacactgccctgtttgaggccatctattattggtgtgaaaagcaaacattacataagtaggtttagatagaaggtcattcactccagcattgttcataatagtaaaaaactagtcaaacacagtggttcacgcctataatcacaacactttgggaggccaagtcaggagtatagcttgagtccaggaattccagaccagcctgtacagcatagagaaaccacatctctaagaaaactttttaaaattagcagggcatggtggcatgtggctatagtcccagctactcaggaggctgaggtgggaggattgcttcagcccaggaggtcgaggttacagtgagctatgatcacactactgcactccaactcgggcaacagagcaaggccttgtcttttaaataaataaataaataaataaaaaggaaaataatatgagtaaactctacccatcagtggtaaataccacatatttctatcaatgttaggcagtcttcctagaataatcccattaaagaaaatccaaaatcgttgtatgaaaaaatacacaggtttgttccatgtgtaaaaatcttttaatcttggtacattttttatcaaaaacattcacactacttgaatacattaaaagagtacaaaagcattccaatgtacatatggacacacaaaacacagggaatgctttctagtgaaattaggagtaaatacaagaatgttaaaggagagagtctcatattaccagagtcagtgaattaattgcctttttttttttttttgagacagagttttgctctgtcacccaggctggagtacagtggcatgatctgggctcactgcaacccccgccttctgggttcaagtaattctcatatctcagcctcctgagtaactgggattataggcatgcaccaccacgcctgactactttttgtatttttagtagagatggggttttcgccatgttggccaggctggtttcaaactcctgacctcaagtgatccgcctgcctcggcctcccaaagtgctgggattacaggcatgagccaccacgcccggccattaactgctttttacaacacaaactatacctgtttggaattagtttttaaatatataagctacaggatgtacaaacaccaatgtgaacaactgtcagagaattttgtaattcaggaacatagcttcaagtgcttcataacatggaaagcaactcctaaaaatagtaattggcttaatttcttaaaagcattccagaaagtgatttgttacaattagcaacagaagaacaacattagaaataagaatactgggaacataagaactgaggtcctccagtaccaagagatagaatcaaactttttctcattagaatttaaagaatatagccacgcacggtggctcacacctgtaatgccaacactttgggaggctgaggcgggtggatcacgaggtcaggaggtcgagaccatcctggctaacacggtgaaaccccgtctctactaaaaatacaaaaaaattagccgggcgtggtggcgggcgcctgtagtcccagctactcgggtgactgaggcagaagaatggcgtgaacccgggaggcggagcttgcagtgagccgagatcgcgccactgcactccagcctgggagcgagactccgtctcaaagaaaaaaaaaaaaaaagaatttaaagaatatagttaaaggaaaaattcactgggctctgtgaaacaggttaaatatgtaaccacttcaaacagaaatgacttagtcctctcacctagttctgaaaatgtactaacatcccattttccatatcaaaagcacgtaatttcattagcaaaagcctctttgttttagacttaaaatcacctctgatccaccaaagtttatgcagttaccaaactactattttaataacattttgacagctttattaagataaaatttatataccataagatccatttaaagtatatagttcagtggcttttagtatatgcagagttgtgcaactatcaccacaatctaattttagaacattttcattactccagaaacaaccccagtaaccatttgtagtcacttcctatttccccctccccagccctaggcaaccactaatctactttctgtttctatttattttaataacatttcaaacttgtaatattattgttctcatgcttattctgggtcgttggctcagaggtttaaaagctcttaaactacccaaatttacaagtcctatgacatcctcattcagaaaacattcaaatgatggtttcataatgttatgatagttccatcttctaagagtttttgatctggagcatatgtttcaaattctatgtttgtactactgctaaattcacttaattagaagaagtaaaatcattctatcgagactcaagaatgagtttgttctgtttatgttaacgattccaggcttttgatggtaggaatggctttagcagtcttctgtggcacaccattatcttaaataatattgtcaccttccccactgtcttcatcctttggctcaaagtttggttcaatctgctgtggttaggcaagaaggctattatcagcagattggctggagctaccagaagtctgactgttcccagtaacattattctcctggttgctggtctcactgttaggatgaggtggctgctgtttgcactcatcatgtctgtttacttgattgagatgcttccctgaaacttatgtaccatcaacttctaaaaacttcatcattaacagttcatagttctgtgctgtgagccaggcctggaacaagccaggatataaaagatccctgggatgctctctaagccatgtggtgtctcccttaggctagaaccatcctggatatagagtcctaggggatgcttagttcctgggagaacatccacatctatgattgaagacacgggtctgaagtcttagggcatagcagtgactggatatagcctttttctgtggttgacaaaaccacagaaagagtttttttttttttttttttttgagatggagtcactctgtcacccaggctggagtgtggtggcacaatctcggctcactgcaagctccacctcctaggttcacgccattcccctgcctcagcctcccgagtagctgggactacaggcgcccgccaccatcccagctaattttttgaatgttcagtagagacggggtttcaccgtgttagctaggatgatctctatctcctgacctcgtgatccgcctgccttggcctcccaaagtgctaggattacaggcgtgagccaccgcgcctggccagaaagagaggttttaagtgacaatattattaaagacattctggagaaaaagatcacctataatcccgtcaccttaacattttctcgatttatttaatattactttccgagtcttgtctataagtatacattttcatacagtggtaatctggcgtgcattctaccttatatccttttccccattaaaataacctttattctacgtatttgaaaaccttggctgggctcagtggctcacgcctgtaatcccagcactttgggaggccgaggcgggcggatcacgaggtcaggagatcgagaccatcctggctaacacagtgaaaccccgtctttactaaaaatacaaaaaattagctgggtgtggtggcacgtgcctgtagtcccagctacttgggaggctgagacaggagactcccttgaacccgggaggcggaggttgcagtgagccgagattgcgccactgcactccagcctgggcgacagagcaagactccgtctcaaaaaagaaaaccttaaggctgggcgcggtggctcatgcctataatcccagcactttgggaggccgaggcgggcggatcacctgaggtcaggagttcaagaccagcctggccaacatagaggaaccctgtctctactaaaaatacaaaattgccgggtgtggtggtgggtgcctgtaatcccagccactcaggaggctgaggtgggagaatcacttgagctcaagaggcggaggttgtggtgaaccgaggtcgtgccattgcactccagcctgggcaacaagagtgaaactctgtctcaaaaaaaaaaaagaaagaaaaccctaataaaaaaaaaaaaagcagcctggcacagtggttcacacctgttatcccagcactttgggagttcgaggcaggtggatcacctgagatcagcagttcaattccagcctggccaacatgttgaaaccccatctcttctaaaaataaaaaaattagccaggcgtggtggcgggcgcctgtaatcccagctacttgggaggctgagacaggagaatggcttggacctgggaggcggaggttgcagtgagttgagatcacgccatttcactccagcctgggccataagagcaaaactctgtttcaaaaaaaaaaaaaaaaaaagggagaaatagaaacttttgtgtcgtatacagacaccagggttttgtatgtgcctttgtctctgtatcccccacctccacattcccacattctcgctagattagctgtcaacctcctctccttggcacctcctggtggctctctttacgcagttgactggactaaatgtatgtacatacatgtatactgtaaaaccttacatatcaccattgtagaatctcccaaacccttcatttaaacatgcaccattgcttgctggtcctttttgtcccattttttgcttccatagtgctattttcccaactactgttacccttaagattcctgacttcccagcccctttataccaaaagctttctttgacatttttctctttccgtgccttcctgcctttccacttacccagtacaaagcctgaagatgctttcacagagaagccttaaattatcccagcatactttattgcacccacaccttttcacttcaaaaacctttttgtcacccttgtctaatattcataccctattttcttctatattctcaattcatctgctccatatatacttgttttctgtggtatcattttccccacctccatttcacttagatcctatatttttttaccctatcttaccctttttgtttggtgccttcctccaaacccaaggtttctgtctttcatcagtcatccttccacctttcactcttaaactctggtaattctggttttcctccttctcaaaaagctcacactctgctaatgtgtatatattgttcacttgagtgcttctaaataaatatttacttttcaaaacagtgaaatctgaactattagcatggaaacaacctctgggaagataagatctccactcaaaagcttcaaattgagattctcctgctcatgttgaatgatggttttatctaatattttctgaaatagggtgactacttgaactacacaaaattgtgaaatgagaatatctttgattttatacttctatttttttttttttttttgagacagagtctcactctatcacccaggctggagtgcagtggcagtcttggctcattgcaccctccacctcccaggttcaggtgattctcgtcccttggcctcccaagtagctgggattataggcatgtgccaccacacccggctaatttttgtagtttttggtagagatggggtttcaccatgttggccaggctggtcttgaactcctgacctcaagtgatccacccacctcagcctcccaaagtgttgggattacaggcgtgagccactgtgcctggccacttacatctattttgattgacttgaaataaaatttaacacctcagggaaggcaattctcatgtgttttgaattatactgagcattaattcttcaggataattatagacttggaaaggtttaacccagtctcccagtccatgctgaagttcctttaagtgataggaggaactcataatctacaaggcaacccaatccatttggtgctaccatcgattgttataaagcccatccttgggttaaaatctactatttacagttgtatttaatgaccttaattctgccctcaagctatataaaatttggatctgttttctacatgataatcttttagatatcttaaggtagttagtctatcctctctacccttcccctcacagtttttccaccctttgagataaatatccttcgctattccaactatttctcatatggtatcatttttatcatcccgattgctccctaaggatgttaaactttgttaatgtcccttccaaaatgtatttggaactggaaataatatcccttggtagctgaattggatctggatgttgcacatctggacactaatgcagtctgaagttgctgtaagttttttagtcgacttgtaatgttggcttatgatgaatttgtaattaaataaaatcccaaggttttaatctggaggattgcctttaagtgatttcttcttaaactaagtctcaatcttcttttagttatgcaacagattttttttgtttgttttttgagacgctcgctctgtcgcccaggctggggtgcagtggcacgatctcagctcactgcaacctccacttcctgggttcaagcaattctcctgcctcagcctcccaagtagctgggattacaggcatccgccatcatgcctggctaattttctttctttcttttttatttttttttagtagagacggggtttctccattttggtcaggctggtctcgaactcctgacctcaggtgacccaccctcctcagcctcccagagtgctgggattacaggcgtgagccatcacgcccggccttttttgagatggagcctcgctctgtcgcccaggatggagtgcagtggcatgatcttggctcactgcaacctccgctccccgggttcaaggcattcttctgtttcagccttccgagtagctgggattacaggtacctgccaccacgcctggctaatttttgtatttttagtagaggtgggggtttcaccatgttggtcaggctggtctcgaactcctgacctcaagttatccggccaccttggcctcccaaagtgctgagattacaggcatgagtcaccgtgtccggcctatgcaccagatattttttaaaaaccagatgtaagactttatacttatccctattaaattttatctcattagcctatcaggtagccttggtttttttcttttcttttcttttctttttttttttttttttgagacagagtttcactcttgttgcccaggctggagtgcagtggcgcgatctcagctcactgcaacctctgcctcccgggttcaagcgattctcctgcctcagtctcccaagtagctgggattacaggcatgctccaccacgcccagctaattttgtgtttttagtagagacagggtttctccctgttggtcaggccggtctcaaactcccgacctcaggtgatttgcccacctcggcctcccaaagtgctgggattacaggtgtgaaccaccatgcccggctgttttttttaagactagtcaagtgcagagtgagaaggggggaaagagtagaacaaggagtttgatcagccttggtttctttgaatcttgatttttgtcatccagtttattgtgctgattcaacaaagggccttgaagctaatgttggaatgttttcagacatataggaaatgataattcatcaaaagtcatggagactatattccaaaagttttatgcagatataactcagctgttgaggtatatgagttaataccactataaattgacatggccaggaaagactgaagtccattgccagcttgctttgtgttgaacattactccaaaagagattaaattttaaggcatattgtgtcaacataaaggcaaaagagctggctaattcttctcaagaaatcaattaatggcagggcgcggtggctcacgcctgtaatcccagcattttggaaggccgaggcgggcagatcacctgaggtcaggagttcaagaccagcctgaccaacctggagaaaccccgtctctactaaaaaatacaaaattagccgggcatggtggcgcatgcctgtaatcccagctacttgagaggctgaggcaggataattgcttgaacctgggaggcggaggtcgcatgaaccagtatcacaccattgcactccagcctgggcagcaagagcaaaactccatctcaaaaaaaaaaaaaatcaattaatgcacgcataatatagagacagagtcattgttaccattctcttattttgcctttgacaagtttatattgagcatgttatcaggcaatgtgggagattctggagaaccaggtttgcctcataactagggttaccatatactctagtttgcctggggcaaccctgatttatgcctgttgtcccagtgtgattattactagtgtaatttttcactttgagaagtgtccaggtttggaggataaattatctttctaataattgatacccttctcataacctaacgggttccttttagtattttatctgggttaaaattaccagctgtaatttggcagctctaataagactgcagcaatacttatcttccatttgaacagattgttacttgaccaagggaagttaatagcaaaagtaactgcagggcacatgtatgtcatgggcaaaaaaaaaaaagtaacagcaattaaggtttgcaggtacttagaatttttcctgagccaccctctagagggcagtgttacatatatatctgtaattatccagttacaacaaaaaaagggctctcattcatgcatgaaaatcagaaatatttcatactcttaaagaacacattggaaccaatattatgattaaaacatattttgctaagcaaagagatattaaaaattaattcattaacattctgaacattttttaacttgtaaaaacaactttgatgccttgaatatataatgattcattataacaattatgcatagattttaataatctgcatattttatgctttcatgtttttcctaattaatgatttgacatggttaataattataatatattctgcatcacagtttacatatttatgtaaaataagcatttaaaaattattagttttattctgcctgcttaaatattactttcctcaaaaagagaaaacaaaaatgctagattttactttatgacttgaatgatgtggtaatgtcgaactctagtatttagaattagaatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtaaactttattataaaaccaataaatagcttcccaagtatgccagggctcataaaaagtaaatagatgcccttagccccctgaactggtaaatatttaggtataacttggcatgattatatatatatctgtattattccgtgaactcttatgttgaacctgtaatgtaactactgaatttatgtgaaaaagactaccatattatgagtcatgcttctcttcatgtaattgtttttaggaagtagataacttgcaaaagatggtagacatccccaatagcaaaatgggtctaatagtaatattaaccatcatttattgagcacttactataagtgctcaatacatatacttcatgcattttctctaagcttcacaatagctttgtttgtttgtttttgagacagagtttcgctcttgttatccaggctggagtgcaatggcgtgatttaggctcaccacaacctccacctcccgggttcaagcgattctcctgcctcagcctcctgagtagctgggattacaggcatgtgccaccacgcccggctaattttgtatttttagtagacacagggtctctccctgttggtcaggctggtctcaaactcctgacctcaggtgatccacccgcctcggcctcccaaagtgctgggattacaggtgcatgcaccatgcctggctaatttttgtacttttagtagagacagggtttcaccatggccaggctggtctcgaactcctgaccttgtgatccgcccgccttggcctcccaaagtgctgggattacaggcatgagccactgcgccggccatatgagtactttcaaatggactgtggtagacatttcaggaagggccattggagtgattgcttctaaagatattttaaaaagttataccattatatatttgacccatttattttaagattgaataatgcctataaaatattggttatttcgaaagattttatttatgtaccatcatatagtaatcttgaaggtttgtttagtgtcatgtagctataaacttagagaaacttacaatttcattatgtagaactttaatgttactaatacttgaaacataacttgttttaaaatttcacagtttgaaacagtaaggacaatattggtggcccaaataacatactaaaaagaaagtatggccgggcgcggtggctcccgcctataatcccagcactttgggaggctgaggtgggtggatcacctgaagtcaggagttcaagaccagcctggccaacatggtgaaaccccgtctctactaaaaatacaaaaattagctgggcgtgatggcatgcgcctgtagtcccagctacttgggagactgaggcaggagaatcacttgaacccagaaggcagaggttgcagtgagccgtgatcgcgccattgcactccagcctgggcaacaagagtaaaactccatctcagaaaaaaataataataattaataaataaataaataaataaataaataaataaatgaaaataaagtatgccaggtacagtggcttacgcctgtaatcccaacactttggaaggccgaggcgggtggatcacttgaggtcaggagttcaagatcaggctggccaacatggtgaaaccccatctctaccaaagatataaaaaattagccgggtgtggtggcgcatgcctgtaatcccagctacttgagaggctgaggcaggagaatcgcttgaactcaggaggcaaaggttgcagtgaaccaagactgcgccattgcactccggtctggggaacagagccagactcagtctcaaaaaaagaaagaaagtaacaattttagtttttaacataaaacttgggcagttttatttttgtcttctataaaaatacctcacattgaatcagtgaatttagtgtgtatttcttcctcaaaggataaaaatcatatctgttacttagatgtgaatttgaatgtcttgttttaagctgtgagattttcatgttttttagatgtgcttaatttttaggtgttaaatgaatatttttgtgtaagcttctaattgcacaaatacatatattcctgtgtgttttcgtaggtgaaggtgataaagtaaagtgctttcactgtggaggagggctaactgattggaagcccagtgaagacccttgggaacaacatgctaaatggtatccagggtaagatatttaattgttcattgtacaggcaagttggatagcatgcagtgggagacttgaattactttttacctcaactatttttgccttcactatggcttgaaattcatgctaggtttataaaaatgagcaaggtttataagccttctctgatgaccaaaaacattcactgcttatgtgtgatatctataacattcagattatccctttttttttttgagacgaagtctcactctcttttgcaggctggagtgcagtggtgcaatcttggctcactgcaacctctgcctcccaggttcaagtgattcttgtgcctcagtctcctgagtagctgggattacaggcacccgccactgccaccatgcctggctaattttttttttttttttttgatatggagtctcactctgttgccaggctggagtgcagtggtgcgatcttggctcactgcaacctccgcctcccaggttcaagcgattctcctgcctcagcctcccgagtagctgggacaacaggcaagtgccaccacgcccagctaattttttgtatttttagtagaggcagggtttcaccatgttggccaggatggtcttgatctcctgaccttgtgatccgcccgcctcggcctcccaaagtgctgggattctggctaatttttgtattttttagtagagacagggtatcaccatgttggccaggttggtcttgaactcctgacctcaggtgatcggcccgcctcggcctcccaaagtgttggcattacaggtgtgagccactgcgcctggcctctagattatcccatttctttttttttttgagatagagttttgctcttgtcgcccatgctggagtgcaatggtgctatctcagttcactgcaatctccgcctcctgggttcaagtgattctcctgcctcagcctcctgagtagctgggattacaggtgcctgccaccacgcccagctaattttttatatttttagtagagacagggtttgaccatgttggtcaggctggtctcgaactcccaacctcaggtgatccacccacatcagcctcccaaagtgctgggattacaagcatgctccaccttgcttggcctctagattatccaatttttaaatacagattaggaaatgtgtgcttttttgttgttggaagtaggctcttttatgatcagcgtgagagcccatattgccaaggagattccttaagaagccatcatacccctaggaaatattaatgtatctcattatctctatgacatacagttgttcacatttttttttttttttttttttttttttttttttttttgagacggagtctcgctctgtcgcccaggctggagtgcagtggtgcgatctcggctcactgcaagctccgcctcccgggttcacgccattctcctgcctcagcctcccgagtagctgggactacaggcgcccgctaccacgcccggctaattttttgtatttttactagagacggggtttcaccgtgttagccaggatggtctcgatctcctgacctcgtgatccgcccgcctcggcctcccaaagtgctgggattacaggcgtgagccaccgcgcccggcccagttgttcacattttaagatctctggttggagtgtggtggctcgtgcctgtaatctcagcactttgggaggctgaggcgggtggattgctggagcccaagagtttgagaccagcctgggcaacatagtaagaccctgtctctacaaaaaatacaaaaaaaaaaattagccagtcatgatggcacacacctgtagttccagttactcatgaggctgaggtaagaggatcacttgagctggggaggcagaggttgtggtgagctgatgccactgcactcggcgccactgcactccagcctgggcgacagagtgagacactgtctcaaaaaaaaaaaaaaaaaactagccgggcatggtggcttacgcctgtaatcccagcacttcgggaggctgaggcagggagatcacttcaggtgaggagtttgagaccagcctgaccaacatggtgaaaccctgtctctactaaaaatacaaaattagccgggcgtagtggtgcatgcctgtaatcccagctactcaggaggctaaggcaggagaatcgcttgaacccggaaggctaatgttgcagtaagccaagatcgtgccactgcactccagcctgggtgacagagcgagactctgtctcaaaaaaaaaaaaaaataacaaaagtcaaggtgctaatttaataacttgttttagaaagttctcaagttgatattttttgctctactaatattagcataggtagcataacagagggaacttttttaaccttaaaatgacagtgggatagggaattgggtaacattttactttgtggctccttagaagtactgaaaagcaagttaatggaattaatagaattaatatgatggagattatatctttgcttatacttcactaatttatcagctactaaagtttaatcttttaattgtttaggtgcaaatatctgttagaacagaagggacaagaatatataaacaatattcatttaactcattcacttgaggagtgtctggtaagtctcatataatttatattttcaaattcacatttcaaattataatttatattttcattatgtagtttatattatatcatttgttttatagttatttcttcatgtgatattcacagtatagtattataaatcaatatatgtgtacattacatcaaaacacaaattttaagttaaaaacaaaataataaatgtatgatgggctttaaagatgagagctagctgggcagtgtttcacacctgtaattccaacattttgagaggccaaggtgagaggattgcttgagcccaggagtttgagatcagcctaggcaacatagtgagaccctgtctctacaaaaaattttaaaaaccaattagccagacttgtggtacatgcctgtagtcccagctacttgggcggctgaggcgggaggatcgcttgagcccagaaggtcagaggattcagtgagccaggttcattccactgtactccagcctgagtgagaaagggaaaccctatctcttaaaaaaaaaaaaaaaaaaaaagagagagcctaaaaagtgtttcttattctttacctgaagtaaatttgtcaaaagataatcaggatgaactgatttaagtatcattgtaggcaaaaatgggcttgaagaactaaaatattaaaagtcccttagccttctgaaattagatctttgtataatgtgctttgtactcataagtagttttaagtttttgcagacaatatttaaaatctcaaatatatctaaattgataggatgggcgctgggcacggtggctcacgcctgtaatcccagcactttgggaggccgaggcagatggatcacccaaggtcaggagttcgagaccagcttggccaacatgatgaaaccccgtctctactaaaaatacaaaaatttagctaggcgtaatggcgggcgcctgtaatctcagctactggggagactgaggcaggagaattgcttgaacctgggaggtggaggttgcagtgagctgagatcacgccactacactccagcctgggcaacaagtgtgacactccatctcaaaaataaataaattaaataaataaataaattgataggatgaattgaggtggccaaggcatcagtaataggtggaaagaaccctggactaaaatgggagactagagttgcccccagtgactctaccttgaagtcattcattctccctgggcctcagctttttgtttgtaaaatgaagggattagattagataatcttatgacttccttctagctccatcaggctatgcctcttgtgaatattcatatattgaattggaataaagccaatttattttaaatttatgattaatttcacttttcaaatggaaatgattgcctctaccaaaaataattctaacttacagttcctatttctgttacaggtaagaactactgagaaaacaccatcactaactagaagaattggtaaatatgcttgttaactatccttttaatttaactgccaatttatttatttatttatttatttagagacagagtctcactctgttgcccaggctggagtgcagtggtgcgatctcagctcactgcaatctctgcctcccgggttcaaccgattctcctgcctcaacctcccgagtagctgggactacaggcctgcgccaccatgcccggctaactttttatatttttagtagagacggagttttaccatattggccaggctggtctcaaactcctgatcttgtgatgcgcccgcctcggccttccaaagtgctgggattacaggcatgagccaccgcacccggcctttaactgccaatttattatagttgttatttatggggtggaaagataagcatgttcttccaaggtcaccatgatatatttatttcagatgacattactataaatttaagaatttaggcggccgggcgtggtagctcacgcctgtaatcccagccctttgggagaccgaggcaggccaatcacgaggtcaggagatcgagaccatcctggctaacatggtgaaaccccgtctctactaaaaatacaaaaaaaaaattagctggatgtggtggcgcacacctgtagtcccacgtacttgggaggctgaggcaggagaattgcctggcctgaacccaggaggtggaggttgcagtgagccgagatcatgccattgcactcaagcctggcgacagagcgagattccgtctcaaaaaacaaaaatgaaaaaaataatttaatgaagtacttataaattgcagtcagaggctgggtgcagtggctgacacctgtaatcccagcactttgggaggccgaggagctcaagaccatcctagccaacatggcgaaaccccatctctactaaaaatccaaaaattagccgggcgtgatggtgtgcgcctgtaattccagctactcgggaggccgaggcgggagaatcgcttgaacctgggcagtggagattgcagccagctgagatcgtgccagtgcactctagcctgggcaacagggcaagactccatctcaaaaagaaaataaaagaaaaaaaaatcagtcagacgtgtctgtattaaaaatgttagtaggccatcagatagtttttccaagttcaggaggaacactgataggttgcctcattgccatctctgctaaaatcacaagagaaagggtgaagtgtctttttgtacctggggttccttaagtaagccaaaattatttcagttttctactagtgtgccattaccctgataagccctaacccacctgcttctttatcccatactgtcattgtaccttccccagcttcttcacagaggtgtaagttttggtttgtttacctcctgttacctcatggagaagtagaggttttaaaactcaaaaagtgggcagagaaagatattatgctaagcaaggaaggtaattgttatccccacttttcagatgaagaaagagtcagagaggttaagtgacttgcgcacaatcacattacaaatagttagtggaactaggaccacaagcaaggtcttctgaatcctacatcacagggcagatctcattttcaacttaggcatatttcaaaagtagtagaaagtttaatttagaatatgtctagtgattccccacttcctaaactggtaccatcatctatttagtatcttaagaattacaagcggctgggtgtggtggctcacgcctataatcccagcactttgggaggccaaggcaggtggatcacctgaggtccagagttccagaccagcccggccaacatggtgaaactccgtctctactaaaaatacaaaattagctgagtgtggtgctgcacgcctgtaatcccagctacttgggaggctggggcaggagaattgcttgaacctgggaggcagaggttgcagtgagccaagaccacgccattgcactacaccctgggcaaaaaggagcaaaactctacctcaaaaaaaaaaagaaaaatacaaaaattaccagggcgtggtggcacacacctatagttccagctacttgggaggctgaggcataaaaatttcttgaacctggaaggcggaggtttctgtgagctgagatcatgctactgcactccagcctgggtgatggaccgagattctatctcaaacataaataagtaaataaataaataaataaataaataaataaataaataaaacataaattcagctccatgactgctcctgcagagcagggctacccactacgcagtgagtggcattactactatttaattgcagaacactatcattaccccaacaagaaactccatgctcacccatcaacagtcattctccattgcccaccctacccctaggccagggcaaccagtaatctactttctgtctctatggacttgcctattctggacatttaatgtaaatggaataatgtaatatgtgtcctcaaggtgtatccatgttgtagcatatatgagtacttcattcttttctattgtagaaaaagagtccattgtataaataataccacattttgtttatccatttgtcagttgacatttggcttgtttctactttttgactattatgaatgatggttctatgaacatttgtgcataagtttttgtatagacatgttatatacccagttctcttgggcatatatccagggatggaattgctgggtcatgtggttattctatatttaaccttttgataaactatcagacagatttccaaagtgactgcaccctttaacattcctaccagaagtgtatgaggatttcattttctctacattcattatctgtcttatttatcacagccattctagtggatgtgacatggtatctcattgtggttttgttttgcatttccctgatgattaatgatattgagcatcttttcatgtgcctattggccatttgtaaatctttgtagaaacgtctgttcatctcctttgacttttttttttttttttgagacggagtcttgctctgtcacctaggctggagtgcagtggtaagatcttggctgattgcaacctccgcctcctgggttcaagcgatcctcctgactcagcctccctagtagctaggattacaggtgctcaccaccatacctggctaatttttgtatttttagtagggacggggtttcgctatattagccaggctggtcttgaactcctgacctcaggtgatccacccacgttgggctcccaaagtgctgggattacaggtgtgagccaccatgcccgacccattttttattttttcttttttttgagacagggtcttgctcagtcacctgggctggagtgcaatagtacagtcatgctcactgtggcctcgacctccctggctcaagcaattctgctgcctcagtcttccgggtagctgggactacgggtgtgcgccaccacacccagttaatttttgtattttttatagagagaaggtttcgccattgttgccctggtggtctcgaacccctgggctcaaacaatctgcctcccttggcctcccaaagtgctgggattacaggtgtgatccactgtgcccagccttgaccattttttatttgggttgtcctttttctactgaacagtctagggggatgggttatctttttgttattgagttaaaagagatctttatatattacagttcttttttttggcttcttttactttctaaatgaagatgatagttatttatatataaaagttcctgtcagatttatgatttgcaagtattttctcccattctgtgggtttccttttttttttttttttcccaagacggagtcttgctctgttgcccagtctggattgcagaggcatgatctctgctcactgcaacctccgcctcccgggctcaagcaattctccttccttagcctccagagtagctgtgattacaggtgtgcaccaccatggctggctaattttttttgtatttttagtggagatggggtttcaccatgttggccaggcttgtctcaaactcctgacctcgtgatctgcccacctcagcctcccaaagtgctggaattacaggcgtgagccactgcacccggccacctttttcactttcttggtgttcttcgaagcataaacgtctttaatttttttttttttttttttttgagacggagttttgctcttgttgcccaggctggagtgcaatggtgccatctcagctcaccacaacctccgcctcccaggttcaagcaattctcctgcctctgcctccccagtagctgggattacaggcgtgcaccaccatgcctggctaattttgtatttttagtagagacggggtttctccatgttgaggctcgtctcgaactcctgacctcaggtgatccgcctgcctcggactcccaaagtgctgggattacaggcgtgagccaccgtgcccagcgaaacatctttaatttttatgacatccaatttatctatttttctgtgtgtgttgctcatgcttttaatgtcatatttaagaaaccattgcctaatccagggtcaccaaggtttatacctatgttttcttctaagagttttatggtgttatatcttacattctggtctttgatccattttgagttaatttttgtatatggtatcaggtaggggtccacgtcctttttgtttttagcaagttgagtttgagatacctgcaggacattgaagtaggaggataataaaaccttgtataaaggagagtaagatgttgctggtagggaaagtgtctggaaagactttttttttttttccggagacggagcctcgctctgtcacccaggctggagtgcagtagtgcgatcttggctcactgcaaccaccgactcccgggttcaagcgattctcctgcatcagcctccccagtagctgggactacaggcacatgccactgcgcccggctaatttttgtatttttagtagagacagggtttcgccatgttggccaggctggtcttgaactcctgacctcaggtgatccacctcagcctcccaaagtggtgggattacaggcgtgagccactgtgcccagctggaaagaccatttttcagaagggtcgatgagggaatggaagggagccaccaacatctaattaggtgggcacaagtaatggagcaacaaaacaaactgaaaataaaaacaagtcaaagataggagaagcaggaaagagcaatgtctagttgccctctggacatttccacctagaatgcatctctaaaaaccactcagactgaatctaatcctgcacttttttctcctgtattggttaatagtaccacagttcacaaggttgcccagtaatttatgttgttcctaagctctttgctctctgtaatccttttacatttaattaatcatcaaatttgatggattccacctttttaatgttgcttcagactttcccacttattctgctctagttcaggcccttccttgtttttcaactggacaattgtagtagtctcctaactggtcttttgtctgtattataacctgccaacagagtttttctttttgtttgtttgtttttgtttgttttgtttttttgtttttctgagacggagtctcgctccgtcaccgaggctggagtgcagtggcgcgatctcggctcaccgcaacctccacctccgggggtcacgccattctcctgcctcagcctcctgagtagccgggactacaggcgcccaccactatgcccgggtaatttttttttttattttttggtattttttgcagagacggggttttgaactcctaggctcaagcgatctgcccgtcttagcctcccgaaatgctgggactacagacgtgggccaccatgcccagccttatcttttatttttattttttaatatagatagggtcacactttgttgaccagggtggtttcaaactccaggcctcaaggaatcccccttggcctccccaaagtgctgggattacaggtgtgagccactgcacccagcctcctctctttcaaaaaacatttattgagctataatatacatacagtagccgggcgcagtggctcacgcctgtaatcccagcactttgggaagttgaggcaggtggatcacgaggtcaggagttcgagagcagcctggccaatatagtgaaaccccatctctactaaatatacaaaaaaattagccaggcgtggtggtgcatgcctgtaatcccagctactcgagaggctgaggcaagagaattgcttgaacctgggaggtggaggttgcagtgagccgagacgcgccattacactccggcctgggtgacagagcgagactacgtctcaaaaaaaaaaaaaaaaaaaaaaaaaatatatatatatatatatatatgattttatatatatatgattttatatatatatgattgtgtatatatatatgattttgtatatatatatgattttgtatatatatatgattttgtatatatatgattttgtatatatatatgattttgtatatatatacacacgcacacatacacacataaagtgcttaaagtaccctaatcgtaagttttctacttgatgaattttaacatatatatgttaaaatatatattaaatatgtgttaaatatatattaaaatgtatatgttaaaatatatatatttatctgtgtgactatcccccagattaagatatagaacattcccacaaccctagaaagttctttcatgctccttccccatcagtacccacccccaagttatattctggcttctattaccatagattaattttgtttattaccatagattagttttgaagttcttataaatggactcatgcagtaggtactcttttgtgtcataatgatgaattatgattatgttttgctcattatatctatgagatccatccatattgtctgtggcaatagttttttttttttttcttgctgtgtagcgtatgaatataccacaatttatgtatctgttcacctgatgatggacatttgagttgtttccagtttggggctattataaataacactactatgaatactcttgtgcatatctttggcagagatatacactcatttttaatacccaagagtggaattgatgagtcagagggtataagtgtcctctcctagcacttccctacacatgctgtgttcctactttaagtatcataaaaacaagtttccattgactttcttgctttattcagtcctacccgctctgctacagaaacgaagtttgagagctaggaaattgacacattcaaggttatagactgggacttccctgatttcccatcattttccccaaataattgctagtgactcagtaacaacatccactctttaagtaacttaggttaattgttaatgagtacagctagattcaaaacagttcagatttttgaagcacttaacctttttcttgcctattttaccttgcatcgtttcaaacactacaaaatacatactcattgcatttacaattaattgtaagattctgaaagtgatttttcagtgcctgaatacttcaaaaaatcttcccaaagcagctttgctttgctggtttgtttttattctttcgcttgctccttaattttttcattttaactatattttgctattgagttgtgataatgaaaataattgtttaaattctatgttctttttcctcaccaatttttatttcagatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaaggtatgcattgctgtttttaaaaagcaagaaagggccagatgtggtggctcatacctgtaatcccagcactttgggaggctgggacaggtggatatggacattttttaaacgtaaccttaatgctgtgtgttagtctgctcaagctgctataataaaattccatagactaggtgtcttaaacaacagacttatttctgacagttttggaggctccaaaatcaaggtgctggctgatttggttattgatgagggccctcttcctaccttgcagatggctgccttctcactgtgtcctcacatggcatgggttgggattggatgggacaagatggagcaagtactctggtctcttttcctctacttttaggaacactaatcccatcatgggggggtctcatcttcatgacctcatctaaacctaattacttcccaaaggcctcatttccaaatatcattacattaatcatggaaaaaagattaaaaatatgagttctaccagcctggacaacataatgaaactgtctctacaaaaaatacaaaaattagccgggcatggtggtgtgtgcctgtagtcccagctccttgggaggctgagcggggaagatcacctgagccagggaggtcaaggctgcagtgagccatgatcatgccactacacttcggcctgggcaactgagcaagatcttgtctcaaaatatatgtatctctcctttaaggatgatggacactgtagtgcttgccaacaacatcgaaggttaaagaagaagtttcaaactgagtacacttttgggtactttacctgtaatagttctctaagctcttgaccatcctccctccaaaaagatgagaattctcctactgctaaaaaaacttaaacgtttacttatttttgacgcatttaagatccttttgatctttaagatatttcaagtgcttttgaaacactattcagataatcgtataagttatgaaacagtatgaacattaatgatatttaaaattatattcattgatgtaagaatcaatggaaagcttccaattttttccttatagatgcatttatttaaaacttacacaagctccacttatcttggtggtggtaaaataaaccctttaattgtcatctttctttctttttttaattttttatttgttttaagacggagtctcactctgtcgcccaggctggagtgcaatggcacgatcttggctcactgcaacctccgcctccccagctcaagcgattctcctgcctcaccctcccgagtagctggaattacaggcatgtgccaccacgcccggctaattttttgtattttcagtagagacagggtttcgccaagttggccgggctggaatttttctactataacagaaacacaagcaattgtgtcatttttttcctgcatcttaaacacgcgcttaattgtttggccataaattgttagttttcaaaccttaatgtatctgcagcagaagggtttagcaggttgtaataggaagagatcaagagactgtgcattagggagagtgtcttttctctatctaacaggagtcaatgggcgctcatattatcactgagactacaaactaggatggtgtgggaaggagagcctaagggttggaattcatttgaactctcctcagtctcactaaattgagaggcaagtaattgatacaggctctctactcatgctgggactgctgcctatttgtcttcccaaaagctgatgaggaaagactggcactaagaatcttttaattttatataaaataaggatggggctaactgaagtgaagcaggtgagggttattagagaaaatataacattgtcacttactgagaaatcctagatttagtgctaaacttttttgccaatggctgtgtaacagagaatgccctagtaaaaggtcttgtaaaaatagtaccgaatcagtatctttttttctttctttgaaaaaattatgtagtgtaagataaagccctttatttagtatatgtactaaagtacttattttaatctttatgtgtatatatattactgtatataatataaaaatcaaataacccatattcatttcttatctgtctttccatatgaatctgctctaatagtaaaatgaataacatcagtttattctagaagaggttttaaataattacaaatattagcaaataacatcaaaagttatctagcctttattgctcatgtgccagtaaccttctgacctagaagagggctttgtggggaggagaaggggaaaggcgctgtagagaagtatgtagaatccagtagttacctttaagccaagagggaagtaattgccagtggtaaactactggtctgaggggaaaagatctatgcccagaatatcaccatctcaagttagtggctttatacaaggatgaaataatatagaaaaaaatgagatgatatggtatcacaaacaatcagaaccaaaggaaccttaaagattattttataattttttttttttttttttttttttggagacggagtttcacttttgttgcccaggctggaatgcaatggtgcaatcttggctcactgcaacctccacctcccgggttcaagcaattctcctgcctcagcctcctgagtagctgggattataggcatgtgccaccacaccctgttaattttgtatttttagtagagacggggtttctccatgttggtcaggccggtctccaacttccaacctcaggtgatctgcccgcctcggcctcataaagtgctgggattacaggcatgaaccactgcacccagcccattttataacttttatgaccttaattgggaacctgaagtacagatgggctgttgcctaggatcacgccgatagttgggaatagaattcagatttcctgacttctggtccagtgttttggggtttgtttcagtttttttttttgttttgttttttgttttttttagattttaaaaaattgtgataaaatacacatacagtttaccatcttaaccatttttagtgtatggttccgtagtgttaagtacatttacattgttgcacagtcaacctccagaactcttcatcttgcaaaaccgaaactctacatccattaaacagccaggcgtggtggcacacgcctgtagttccagctgcttgggaggctgaggcaggaggattgcttgagaccaggagctcaaggctgcaatgagctgtgattgcaccactgctctccagcctgggatacagagcaagaccctatctttaaaaaataataataataataaaaacatgttcattaaacaactccccattccctctcttcccaacccctggcaactaccattttactttttgtctctataaatttgactactctaggtgtcagtattgttgttgctttgtttgtttgtttgtttcttcctttttgtggagaacggggtctcactatattgctcaggcaggtctcgaactcctgggctcaagctatcctcccgcctctgcctccctgagagctgggattataggcgtgagccaccgcgcccagcctgtttgtttgtttttaactcgttgtagcattacatctaaaagtaatgtggaaattacttgttctccttttgatttttttggcatgaaatacacacttcattctgactttttttggtgttgatgctttcttataatataaatcagcttatagtgccgtttctttacttgtattttttcctctgccttgagtacgttttctctatctgtatacctagtcccattccccactctacccccaactccctgaatctactttgtgaactcatgtttcaaggttcagctcagaagtcacttctttcaagttttctcccgcacccacagcagagttaggagctccttcttatctactcctggtgctggtagagttttgttttgttttattttgttttgttttgtttttcttgagacagggtctcgctctgtcgcccaggctggagtgcagtggcacacaatctcagctcactgcaacctctatctctcaggttcaagcgattctgctgcctcagcctcccgagtagctgggattacaggcatgcgccaccacacccagctaattttttttgtgtgtatttttagtagagatggggtttcaccatgttggccaggctagtcttgaactcctgacctcaaatgatctgcccgcctcagcctcccaaagtgctgggattacaggcgtgagccaccaggcctggctgagcattttgctttttacactattttgggactggtttctgccctgcccattagaccaagcttcttaagggtaagtgctttatcttcttatctctgatgcattccatgtttgagcctatagtttttattatgcccaagagggtactttttaagaagaaagagattaaacaatcctttcctctaccccctagccagagaaacctttctgagacatagatgtgatcatatctgtctctagtttaaaacccttcactgcctcccaggacccttgggatcaagtccaaactcctttacgtggctcgcctaatctttcatgatcaggcacccttttgtagcctcatctcatgctattttctcaaattctgtgcccaagctttgcctgtgcacttgtaggccacgttctgtctctctccttggagcttgtttatgctgtttcctttgcctaaaacacttttctcccattgcccttatcccccaaggcctccttctcctagtaaactcctaattcattcttttgtacccagttttaggtataatttcctccaggaggccttcgtttatgcatgcatgcacacacacgcacacacacccttcctgtgctcttcataacacattgtaattacctttgtcatcataccatttatactttcctgtttgcttgtgttctttacttgtctatgaactattgggggcctgaggtttatgtatttgttaattgtatccctagtacctagaacctagttaagtgtccagtaagtatttcttgaataaactattgttttccaaacatgttttcagaatagtgttcagcaggatgttaaaaggatgccatgaaaaaggaaccccatagttaaatagggaaatgccttgtacatttctaagagggaacatagactatactgtcctatattgtactgtactgccctgtcctggatgacagtggttctcaaacgccagtgtgcccaaccccagaaattttagattctgtgaatggagcccagaaatccgtggtttaaaaatgccccaggttattctcatgtgaggccatatttggaaaccactggtacataatgattataaagatgctaaaataaataaatagttgtgatcacaaaggtatagttaaaatatgtaatgcatttggaatagtgcctagcacgtactatttatgcaatattactggtaactgctgctgctgttgtcattattgttatatgtgaccatgaaacacatgttttgtggcatatttattcacatttcacaaaactattttgggaaaggctgaattaagcaagtacttcagtgccacctatatgctgatgacatccagatctctatctctagccctgacttctcctgacctcaagatttgactcttcagttgcctactggttatttttatatgggtgtcctgaaaacacctcaaaaatatctgaagatcccaaacctgtacctccttttatatttcttattggcatcaccatatccttgtcagccaagctagcaatcttgtaatcaactttagtttgtctttcttcttcagccctcatatccagtcagtcacccaatcctacttgtcccacttcagaagtgtccctcaaatccatccctctatttctggaattagtcgtgacctttccatatgctgctccttttacctaacccttgtttttctgcctggcaaatgactgtccatgcttaaatgtcactcctccacttccctcctcccccgatccagccactgccaacctgtgaagccttctccaactagcctgagcagaagaacttgttttctcatcttgtcccagagcactttgtacataactttattatagcacttatcactttgtactttgtgcttaacctcctagcctcatcttacatcctctcccactagcgtgtgagctatttaagagcagatgccacgggtgagtcatcctcatatctcccggcacttgttgggtgcttggcacgtagtaggggctcaataaatgttttcaatgaatttaaacaactaagagagtctaaaactagcataattattttctctttttgcagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcata

SEQ ID NO: 2166 - DNA, 53813 bp, Homo sapiens; identical to SEQ ID NO: 2165

SEQ ID NO: 2167 - DNA, 19955 bp, Homo sapiens
gggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcggtgaggaccggacagggacgggggtggggccctcgggcagcccagcagcggaaccgttagccggagctgggcgagccggcgggcgcgcggccggtgggcaccgactccgcggcgcgcggccgcccatcccccccgtccccccctcactccctctcgcggggacccgcccggcaggcgcgcgcgcactgcctcccgcgccccctgtggaccccgcgcggccgcgcgcccctccccctgcggccgcgcgccgccgaccgcgtgtgcgacggggtcccctccccgccgaccggcctcgtgcgctcgggcccgcacgccgttgttcgcgtcacccccacccagctcccttccgcgtgtgctcggagggcgcggcgcaccgcctacgcaggccggagcggcttccccttccctcacgtgctctccgtccgcggcctgcgcacacacccatcctggggcccgcgccccgggcctgccctggagcgccccgcgcttcagactcacccacgtgtgcggcggcggcggcgactgcgtggccccgcacccgggcggtggagagaaagggctgtcaggtggccgcggcggccggcgtgcgagggaccggatgcccaagccgggcggatttggaaaaggatagctggtaatcgtggcttgttttgctttgttttcttttccagcaacgaaggttttgggaacagtaaaatggttcaatgtaaggaacggatatggtttcatcaacaggtgagctgccgggctctgaagcctccatcccaccttcttgcttgcttcctgctctgtcggcttctcggggcttgggaagccccaatccacagctctgttctgaaaggcgtttactacctctggtgtattagtatgattttttgttgttgttgttttccttgattagggattagtggatctagagaatgcctttgttttgcagctaaatattaatttgaagctaacttaaaaggcttcgtcacagtacaaagcaattcaaaaggcaagcggagtgaatgagccattccttaacagggtaaacgggaaactacggtccagtacatttttatccttgtcatctttttctactttattgaactcggtatttgagaatgtgatccactgacatcggatatttatacattgttaacgttttagggtaagaggatttgactatatgaggttttgtcatctttaccgagaggttgtattgcctttgtttcacgtttcattttaatacctgagataaattttgtcttagcacagctttgaccagagagaactgtttttatttgctcatccagtaaataatatatttacaagaaagtggttttttttccttcttccgttcttatttttcattcttccttgtcctagaatcataactggttaagtcgatttctgttagatccctggctgtagcttattagagtggccatagtcactggtaacttgacatttttcttcctgtttgaaggcaaagctgcagacacgtctttaggacttacccttcgggttgtttgtaggagtggtggtggtaacgtgcagtagacgcactgtattccatgggctcccttgtaagccgggcatcattttcaagatggctgccaaggctagtagtgctagttacatgggtgcagagcactgggtatgccagtagcaatcttggcctcacaggtatggtacttagtgccatctcagcattgtcttgcttgcttactgtagaagacctaagcagatgattaaaagaacaatgtggaatggacaacaaatgggcaaaatcaagcttaaggacagaatcattgcctgatgaaaaactgttcattaatcaatcatagagtattgtggaaacactcagagtaagagataagcatttggtgatctattctctacttttgcaattgtgggaaaatattttgtttcttccaaaatcttaggattttccatcttgttatatactgtttgctttcctggctggccgaaactacgtttttcattaattttttgataatggcttactagcaagaaggaagggaatgcttatatataattggcatactgatagctttttaactgatctctctgaactttctagtgttttagtttgtatttctgtcttactctgattatcgttactagtctaacccttaaaccagtggttttcaaatttaagtgtgcttaccttgggagggtgtgatgtaagtggtgagttcctccttctgagccttggattcattaggtctgggtacatttttaacaggaatgataatggtcttcgggccataccttcaaaatcactgcttttaacccttgacccaatgtaatggtaactctggtgtgcaaatttgcagccttttcagcggatagattgcaggttttgtatgtgttgaagaagttttagcatgtgccttgtttcgctgcattttttttaagtaggcataggttatgacattttttgaaatcaacagttttgtccagaataagagtaatatctttacattttttaagtatttagtccatgagatactgttcattgaatatctctattctgaattggaatcaactcaattggtcatcctccagggcaagttatgaattggcttttgatggtcctttgtttggactatcctaacctcaattattttgtcaaattaactggttaaaatgttctttatgcttctgaactggttttaatgattctgggacttttttaataagatgctgtaaaatctgactccaattaaatacagggaagatttgctttaattaaggaaaatgtatgtgataaaagaaatcactttggaagctagcagttggttctatatgtagttcgtgtagtggaacaaatagacttggctggaggcacctgtctcttatgagggagggagacagactgacacataacgtgctgttttctgtataaaggagagggtgcagtgttcgggatgactattgtgacgacttttaattggggtttttggatgcgctggattatatatgctaggattgtaaggaatttttataattacaatattgtatgtaaattttctgcctttaaagacataatttcattgtaaatgtgtttattccagcctgaattaccacctgatgaattgttacaaccttgttagaattaattcatgaaagggcttctccctgatggttatattgtgaagaaggtgctaagtaacatgagcatagagcttttaaaaatagcagaagttttggctttattttgttagactgtgtaatctagaaattctaagaaattcattgagttattcttttgtgaactgtgtctacaaaacataatcggagaatgtgactagaggggtttattagctccccccagattactgttgaattttgttagtggttgagtattgatccatattcaccaaagattaccatgaattggcaacagtttatagtgaccagaataggaatatttttctgtttccagagtacttaaaatgtttaaattaataattcttaatgttttgaggtgaaagaatttggagcagaggtcacaaatttgtgaccttctggctaaaactactcccagatgctttgattagacagtacagtattttttaaaggaattgggattaattactaacatttataattcaggagataacaccaagtaatccagattattatatttttaagatctgaactttagctggctttgggggcctgtatttccacataagtaaaaaccacctggccatattgtcaccacatttaggtggggtatactttttttacgacagccttcacgcctggcctctgtgtatgcatttgagtttattacccatggtctaggaagatgtaataaaccaagccagggaaaggtttggctatctctctttagtcacgcctatcaggtttagtctccctttggggtgggggctcccttgtggggattccatatgtacataactgataggtgacttccaacacatgttggtgaaaatagatacagctaacaagtatttatactagggtctatagtaagtgcttaaaatgagccaatttacttaatctttaaaaacctttgaggcgtaggtactgtcattctgaggcacaaaggagttgttacttgtccccataagcataggtgataagtggcaggattggaactgttttttgactctggagttagtgttcaccaactgctcttatgctgtctctgaaatagaccctagccattttcaatttggttgttgtccacatagttacagataatttcttagggtgattatttttagccgttgaaagactcttaaatgatccaagtatgtcactggggctcttgtctgctgacttgctaggtcctggatttgaaaagttttctgcctttcactatctactttgtgaagtttgggattgttaaaagttctagtttagcatgtaggtcagctatacaaataaaaggacttgcttaattcctgatactgggaggtgaagaattaaaggagagaatgttgcaccttatctcccttaatcttttttttttgtatggcctgcaaggtaagactgaatattgcctttttaaagggtgatttttcttgagatggagtttcactcttgtcacccaggctggagtgcaatggcacgatcttggctcactgcaactccgcctcccaggttcaagcgattctcctgcctcagcctcccgagtagctgggattacaggcgcccgccaccacacaggctaattttgtatttttagtggaaacagggtttctccatgttggccaggctggtctcaagctcctgacctcaggtgatccacccgcctaggcctcccaaagtgctgggattacaggtgtgagccactgcgcccggcctctaaagggtgatttttttttcttttttaaaggtggcggtgtaaagtacttactgtgtggttgttggttgtttgaagtggagtctctctgtgttgcccatatgggtcttgcactcctgggctcaagtgatcttccagcttcagcctcccaaatgtgtggttcttaatagaagtgtaaacctttggaaggatgtcattaccaaaaatctcttgggctgttaaagtcacactgatcttaacttgatcacagtagatccattgctaagccacataagtcatgggtagaccgtaacataactgacaaaatgttttggcactagggaaggtttaaagacttttctgcaggtgctgctaagggagagatgtcgaaggttccaaactggaaccctaaagacaaacatcaatgacatgtatgcaggagacattaggagagatttgtatgctggttatattaaccattgatcttaagctggcaagaagtcatccgtgttcaccaagtcactgatacgtgacttggagaatactagtaggtcccactccctgtgtcctcccaaagtacaatcctttactcttgaaatctaggatagagaactagtatccagtttgactcgtgaacaatgtgagtttgaaccacacaagtccacttacacacagattttttttgataaatatattggaaaaatgtttggagatttgcaacaacctgaaaacttcagatgaaccacatagccaagaagtatcccccaaaataaggaaaagttgagtatgttgtagatactagtctgttttattatttactaccataaaatgtacacaaatgcattagaaagttaatacagccatttgcagttgagaaatgtaaacaaacataaagattcaggcagcattaaatcataactgcacgacattcactgtagtaatattgtactattataatatgtagccactgcctattgctactgcagtgagccccttaaaatgccatgtgacgctaatcatcttcacatgaacagtttatctctccagtaaattgcatgtcagtaaaaagaacttgtagtacacaggtattgtggtttagtgcaatactgtaagtcttcaatagcaccatgggacccatgcaaagtggcgctagtgatgctgagaaaagtcatggcattgtaagaaaaagttcagttgctcgatatgtgctatagatgaggtctacagctggaattacctttcagacagatgtacacttaccgtatcgataagtgcagtactgtacatgtattttctcttacaactttcttagcattttcttttctgtagctttattgcaagaatacagtatataatacatataagacagaaaatgtgttaaggatttatgttaccagtaaggctttccagtcacgagtaagccattaaattttggaagagtcaaaagttacaggcagatttcaactgtgcagcaggttggcacctcaaacttctatccaccctcatagatactgagttattcaaggatacactgtattaccttcctgtccccctagtcctggggctgcagttgctgagtttgctaccctccagtcttagcccttggaaacatacagtttgtccgaaggcagaatcatagacaatatgtgggaaacagaagtgagtctgttgggtgtgaagggtgtttaatagagaagaaatacaaagataagtggacattattatcttacagtcatctacaaggcttggaaattggtatctggttgctttaggttatggagcatatagatggtaaatcctggagtttttataaccacaggattgtaaattagtgtatgcagttacgtgaattaaggtgttagactagtgtggtctggtgatctgcaacaaagtagtagtataagagcatttagttacggataaatttatgtataataagtcttatttaaggcaatactgtggattggcaaaaaagttttctaaaatttagcttattttttatgtagatatacagctaggataaagatagttatgttttaaaaggagtgggaggggggtcaaacatggtgaacatgctggagtagagtccgggagtttggatggattgggccatgaaaagcaaatgctagaattcctagttcctgtggcatggagaattatctggcaagctgtaattgtcttttgacttactaaaaagttttccagggaagttaaatttttttgcctttgttttcccattttgagttgcattttgtctatttttaagacccttaccaatctggataggccatagtataggagtggtagcaattagattttaatttagaaatctggctagtattagtgaatagtaaatgcccaataaatactaaaaagatttgagtacctaccttagtaatgtaagttattaagtgtttagtgtagtttttctcattttgcaggtaaaaaagccaatgaggcagctttcctaggttacacagctgttaatagttgagtcaagactaaaaatctagcagggcgtggtggtgcatacctgtaatcccagctactcatggctgaagtgcaagaacttgaaccccgaaggcagaggttgcagtgagccaagatcgctactgcactccagcctaggcaacaaagtgagactccatctcaaaaaaaaattgagtactgttatttctttttcttttctttttttttttttaagatctgcaaaggggtttaataatgcaaatatcacatatatttccatttttaacaccatatttaagttttccattttcttaacaatagaaagtgataaaaatgtttttcccaatgtaataatacaaatggaaaatattatagacagtcatacactaacccaatgaataagattcaccagaagcaaaatctattttgggggtcctatattgttacatatatacagggcaccagaaccacatttagactaatactttttatttctagttaaaacaatgcagggcactcctgtgacctgcaaatctaattgtacatatgtatgtgtcagactgtgcaggtggccaagaagaatagaaagaaagactttatccagctttggagttcagggcctgattgccccagctttagcccataggaacttgacagcttgttcatacctctcatctttagtcatagtttctctttctccaaccccttttctccctaactaccctgtgccatttagactggaaattctaacaggtagctttttctttctgaattatctttactactgtataatttttattttcagaatattccttatttctacatcttgaagacatttctttctagtagatgggggagctagagcttacattcactgccggaaaagggtcagttccagtgttaatttcccagcaaacacctgagagaaaaactgaacagaaaagaatagtgatggctggcagagagtgacacctgcacccagaaagctgcactgcagctgtctaatatttgagggtctcttttgttataactgccagtttaaactagagattctggctggttgcaaattcaaagcagatcaatacatttaaatcactggttcaacaaatcactctttttaatggtataatgtttttattgcaattgaggacgttttcagtaaataccttgagcttgaggccctggctaagtattccttttgcaatactgtttttactgtcatgacactggtcagtgaactgtgttagtttcacatatctatctatgtacccacaaaacacctccctgtctttgcaggagtgacattaccctgtgtgtaatggcagccttgtgctttctctgtgcagagacagggtcttgctctgttgcgcaggatggagtacagtggcatgattatagctcactgcaccctcatttccgggacttgaatggaggcccggctaattttttattttttatagatatagggtctcgccacgtaactacttttaattatttttattgccgggtatgatgatattgatatgtgaatacctgttgtaactacattagaaggcataacaaacagtcagagccaccacaaaatggattgataaagaaatgatgtattacccagataccatgagtagcattatcagtaatgaaaaattctccacagaagctgcatttttagtgaatttaatgcgtattaaaacagtacagaaatacatacatgactcagataacaataaacaaatttactttctataccaaatctttacatagtcttctagcaactaacacccaccacttccattaatgcagatagtgctccctatctttggaaaaaaattttatttttttattttttttgagatggaatctcactctgttgcccaggctggagtgcagcagctcactgtaacctccgcctcctagcttcaagcaattctcctgcctcaccccccagagtagctgggactataggcacacacagccacgcctggctaattttttgtaattttagtagagacgaggtttcacgatgttggccaggctgatcttgaactcttggcctcccaaagtgctgggattgcaggcgtgagccactgcacccggactggaaaaactttaaataccctgccaggggaagtattgcccctgttgaaaatcactattctagactttgcctgtatttgcctttcttactctaccagttttttattgtatttccccttagagccttagagtttgaaattcagtcatattggagagcagaactaataaatgatggctgtaatctgtttttgtggtgcctatggagttatggacagatggacattaggtacagccatcatttccctaggcaatcctaatcatctagcttgaaaggtcagttttcagtcacttgccttaagtcgcttttacagtttacctgttctgtttttttaattatcctgttcccatcaattaaaaatgttcttataataatccaagctataatttacaggtcagatttaaagttaattttatgtggatcctttgatgcatatgttgcccccagttcagcaagaagctaacagtcagtaagccagtttgtccagttcattgtaacctttgttccctttgtcattaaacgctagagctactactgagctttttctcactctgacctgacggagtaaagagggtgaggcaggccactgcaggcctggaaatccgtttccttctccagtggtgattcttgctcctcgtgttatcaccttaatcccaatatccaggctaaaaagtgagattattctctaccccctcgcttctgacatccagtcatccacaaagtttctcattttgcctcaaaaagagatctcaaatgtctttttatacatggctccgtggtctaaaccttcatcagtccttgtctggacttgtggagtagcttttataactgggcttttcttacattcaaacataccttatcacccaaaggtcacagttcccattaggtttcactctttgcgttatacattctgttggtggggaggggggttctcatttttatgatctcaaggaaagttggtagttgggagatgcaggataaggtgagaatgtaactactacttctgttggtaaccatgctctagaggtaagaggagggtgtgctagaacagttaatgtttaataggataaggaggggcagaatatattttgctagtcattgctaccctcttaattatggctcagtaggtcacactttaatttcttagacttttttttttttttgcctatcttacgggtaatgaggctacaactgtttgcaactgctgaagtcttgaaagcagagagcatggtggcttgtgttttttgatttttgccaaatttcctggtacctaattggcagccagagagtctctgggaaaattaatctttgacaacatgagatttatttcattttctaacttgttcaacttggttctgtcttgcaggaatgacaccaaggaagatgtatttgtacaccaggtgagtgcttgtgtagatatttgcacttctgattcaaggattgtaagaagaaaaggttagatatgttctcagcttttgttccttataaaaggttaagtccaaccaccagtttatttacttacgacaggagtagtagcatgcttaaaaatgtatacgtggaaatgtgttagagttgacttaattatcctagacatttcaaattggaattttgtcaacagctgtggctttctcaaatgttgagtcaaactcactgcattaaatatttatacctaatttcagatgaacagattattccatgattctaaagttgaacaaataatgttgctataaatacacagaaactttggcaagaagttttcaaaggcttttaggtgtacctgtagggacaaatctccataatcaagggtaaataagacagacctgcaaaacatagtaattgaagtgagtacttgaaaagtagcataaagagccttctgcttactttaaatcactttgaatgggtattgggttttttttttttttaaacctttggagagttttggctggcttggaaaatgaaaaaatttcactagtttaaggttaagtggggggaagtgtgacaaggttggcagctgctcattaaataatttttagattggcttccagtgatttgggaagagaaaactgttaacataggatgagtactgatgagtactgcatagtgaactttctccctaagtatcatttagggaaaatgtttgcacattcaggaattaagattattactaatgtaaaccactgccaagtgtatgttaatacttcaaatttagatatgctgtaggctacattgaatgtacttatcctcacagatacgaaatgagtaggaaaaaatatgtttgtgctatcagttttctcactaaggcttttgaaatattgtcaacttgtattaaaattagagaccataactacttttttgtactataatccagaaatcaaaagacctaaaagttaatatccatactcacatttaattagatactagcttttatggcagcatgtttcataggaagggctgtcataggttggtgctttgtagctcactgaagtgtcctacacagtatttgatgacaaggaggaagctatatcaatttctagtacacccaaacccaatcaggtagttcagggtcaaatgtaattatggaatcatttaaattctaaatgtaaataaatacaggactacttcagacaaaatgttgttttaaagtagatgttttataaaattggtattcttgtttggaagaacacagctcaactgttccttactccccttctgcatgttcaaaagaatgtgtagacttaggaacaagagacagcaaagtttctcggtcttgttgcctgttggcaacccttaagggttggggttggggcaggggtggagatgttgataaaaataaagagttgggattttaattatccataattctgctatcccctatgactgcaggtaattgatagttggctatatctgaaaggtatgaaaactatgtgacagtttagatgacagatgagatcaattatttgactcaactcacccagttgtactgattcacaaggtgccaccaatatgctttcatttttttggaagtggtttcaacatgtagttgtttcttgggactttggctgctcaggtcttagtggtgtatcagggagactgcagttctgggcagcttcacttaattggcctcagattcgttgattgtcctgtctcctctgcaatggaaatgcatgagtgatcctgtaatggatatagctgagatttggagtgaacatgggatttggagacccaatacctgggtttagaaagtctccttactaactgtgtgaccttgggcaagtcacctaactttaaagcctgttacattatctgtgtaatgggattaacaatactttcacatgtcctgtctcataatgagattgaatagatagtaagtgaaagaatgttgcaaaaaaatttcatagaaacgtgagatgttactcttcctcccttctcttaacagtctggagaaagtagaagcaacaagtctctaatacaagatttattgaattctggggaggtgataactaacaattccatgcagtcagatcatataaagaatgacatagttaatacacatgaattgcatttccactgatgtattatcagattggaagggattttggttgacatttgtaattgagtttgatacggtaacacaggggcaaagttggtttggtcagctttgaagcatgcaaaaccaaactcgcctgtcatctaaactgacgcagtgtggggccaccttctcctattaagtgcagtcctcaggggatagatggatatcctcatttgttaaaagttatatataatgcttttgcaaaaagcagtttttaaaatgatgtgtctgtcttgagtgttaaattacttgttttagttttgtaaatagtggtacaatgctggggccttgtatgattggagtgtttttgttgaagttggggatagtgtggtccccgctttcctaaatttattgatggtttggtcttatttaaagcaaatcttaagtgtatatccaagctaaaataatattgactctggtacattttaaatgaaaaagcacattattctcccctgttaatctatttttggaatgtgatattactagactgccataaagaagaataaccccaggaagtaccttcgcagtgtaggagatggagagactgtggagtttgatgttgttgaaggagaaaaggtgaggatgctttttgtgtaaaggtttgacttcagtatggaaatattttggaggtctcatccattaggatggtggctctaatgtggatggatgtgttcaggtgacctcatgaacacaggtgcatcaagcctaatgttctggctgcagttagagggcaatctcttcagaacagtgaggaactgatatttagtcatttctgtgcacccctggtcacgcagttgcgcccccccccccttttttttccttaactttgttgttttttgctttgtttgaaaatgttctgatttccttttgaaagtgttgaaagtgttctgatttcctttgtcactatcaatatgtaatggcttttgtagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggaggtaagtttcaccatcaacaacagcaatgtgataagttctggtaggactgtttagagctgttaattatatggaaagcaacttggattcctagtaagaaccaaaaggattaatttataatgtagtcacaattactagatggtctgttttgtttgttttttaactcttggatttatctggttgggtttttttattatattactgacccagtaggcttaatttccattgtctttttcagggtgctgacaaccagggtgcaggagaacaaggtagaccagtgaggcagaatatgtatcggggatatagaccacgattccgcaggtatggtccacgtaaacatgtttctattaaaatttcctcaaacccgtgttaggactcagcaatatcatgcctctcctgcagactcatttttctgttaacacttcacgttttctttcatcagatgcctaagaggtgaacctattaaaaacagcttgtatagatgaggtctgctttatacataaatttttttagaaaatgatgagggtttggaatttcaaattttctgtccttgaacaggtaagataatattttaaaccacaccttttaaacctgcctccttggtagggagaaaggaaagcattaggagtatctgaattgtaccatggcattagtgaagaatcaacagtgttatcacttgaaatggcatacattatcttccactaaacacttctcagtttagatatgtacccccttttttttggagttgggagttgtcagctcaaagttgcaaaatgaaattgctccaccaagaatttacattctgcggggggaaatccagtctgtcgttagacaactatctacttgagtgggtattagaaatcttattaatagatgtcattattagagtaatcgaggaaaaattccatgaaccaagcatattttagtccatgccgtagtatactttgaggcagtgttcccagtcccacggtggtaggataggatggtgtaatagttgtttctctaagggtttgatatcaaagcattgagttttcataggtgatccccaaaagctgacaggtacctctgaagaatcaaaccaatacagtaataacgcatcttaactgatcacttaaatcgcaacttttaaatccccaaatttttaagtgtcaagtttattattctagaagtatccaacatatccaaaatatactgtgagtctataagagggggtttctgtatataggtttttaaattttaccaaagttggagcacttagtgaagttttaggaactagggaatctagtcgaggttgtattacatgtatttatcagcacatgtacattgagagttttgcaagagcagctgatgtcatcatattttttgtattaatatgtcttgtcctgagttttcagttaaaagagctgaggtcctaactgatcactaccacaattgaagatctctgattcagttttctaccaggagattgtgttagccagatgctggatgttgaagatagatgggtttttatttttcagagtaggtctaaaatagcctctcatggcagtccatctgttaagtccatgggttccagcagcagaatctttggtttaccttttgttacactgaagagcttaaatgttttgcctagtttcattgatgtccttaaaaatagcataattttgtgtttgtattcagtgcttcagttcaccgttgagtaaattgtttgtctttatattgacaaacaagcttgcggttgatttgtctcttagaaaggtatctttgtccattgttacccctccagtgcagaggtttttgccttttggtttaagttagacttaatgtctacgtgtttcaatgtttagaatgctcagtcctgccagatagttgcagaagtaacataaaattgcttggaagttatcaatgaatgctagactttccaaactgtgcaggaatcttttgttcaaatgagagtaaatgaaacatgctgcccctaatgcatggaatggtgtgaaattctgactggtgtgggttcaagagcaaactgaaagggaaatcttaagacagagtatagtacaagtgttgctgaaaatgagactaatagtagtaaggggaaaatggggggtcaaaaagggaggttttttgttgagaaataacatttataggctgaaatgcaatccaggataacagttgatggcaggaaagtgactgctggaactgttttctttctcagagagggtagggttttgcccacaggtgaaaatgttgaccttttgttaggaacctgccgttttcctgtgtaagaaacaagaatacatgggcacgcatgtgttaatgggaagacatggaagcctttggttgctaaattgagacgaaagtaaagaggaagtttgaaaagtttggggcaaagaaccctctagaacagaaaatagagatggtaaatttataagtaataggataacgatcataaattagaagtgagttcacccagcttgactctgtgtttctagccatttgggcatcaggctcaggttgggcagagagttggatttatccagatttggtttatccagatctggtttgatttatccagatctggtttatccagatgaagacactggggtagggattggtcatatgattagtggtagactttatacttggataaagaggggagaaaaggggaaaatgagggttgtttttttttttttaaattgttttgtagaaatggagttgcactgtgttactcaagcagtcttgaactcctgccctcaagtgatcctccccaagtgctaggattacaggtgtgagccactgtgcccaaccttggagtgagatgaataggtgatagaatcgctgtattacaggtcctagattaagaatgagaaaacaataaggaattacctaagaaaaataggaaggtacataattggaaagttgagtggtataattgaaaaaacccaggtagaaaacagctggactgggaggtcagtctgaaagcccaggttattagaagctgttacactcgaaccttagtaataactgcagtaagaaaaagatagtaaatggagcagaatccaaaataagatggaaagcctagtttttagaaactgggagagttgatttagaagccacaataaggttagaacagtcaccactgtagggttgcagagaaaagtcagaacaattttgttgaagattcatcatgagttccaaaagatgtggggaaagagttttagaatgtacaaaggtaaatgtgaatttattcccatgatgactcatggatactaaaggcctggggctttctggagtgctcagagtatgggcagaggaaaggccaggaatccatcatttctgagcactgggggaaagaaaatcccaaaatttagtatctttatcttggtgattaaaagactcaagcctgtaatcccagcactctttgggaggccaaggagggaggatagcttgaggtcaggaattcaagaccagccttggaaacatagcaacacatcgctactaaaaatcagacattaatgagacgtggggggcttgcctatagtcccagttactcaggagtctgaggtgggaagatcacttgagcctgggagattgaggccacagtgagctgtcatcattccatggcactttagtctgggcaacaaagcaagactcttccccctactcagcatccccccccccccaaaaaaaaaaacccatctctttacacaaattgcctacagaccacttgatacagaatgggccagacatggtgagttagttgtgaaccaactggttacactggtgggtgtgttgaagagagaaggttttatcattcttaagtttgacaccgttcattgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccgggtaagcaagcttggatggccatccatttatggcagtcgtgagtggtgaccatttcgttttattaatgcaagagtagaaaaacctcagttccatcagataatgaaagccatgttatttataatgtgttctgccctattcttaattacctaatatttcattttaggaatattgaatatcagagtcatatttggccacccttcagctagttctcaattctgacactggagacctgtattttcatgagtattttgaactattagtgctttctatcaacttttctgaatgaattttatgatttcactagtaaacagaggaaagttttgctagctgtattctgagaaatatgttaattacattattatttatgcattatttcaaaaaggaagtggggatagctgttagaattaacctagatggtgacaaatagagtctgtttggagaaagtggcaacattaatataatcttttaatcatttctaattgttttttttttttgttggtttatgttgttcccggaaaaagacgagagtgtttcgtgtctaaaaaactcctagaatgacacgtggtttatcatggtttatttaaactgcctgtagattaataataataattctctggcagaccacatgatacaattacgttcttgttactttagctcattagctcacttgtttttattacccttaattccaaaattaagggattctttttcatttcgctttttacatgatatcgagaggtacgtgattgttgttccctccaaaattagcattcaaccagtggtgcttttggttttttcccgtttactatttgctggatggcaagagatctgttaatgtctcccaatacacaagtaatgtaaactagggcatgtactacactaaatgaagatcaccatgaattctacatgatcatctttatttttttctttacagtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataat

SEQ ID NO: 2168 - DNA, 34418 bp, Homo sapiens
tctccattgcacttttatttgaatgtaatatttgggacaattattcaaaagggccaatatttcccaatttaatctgaggtcataataaaacaagcaacaaaacagtgtttgggatttcagtttctcacccttatcatcaagactcactgcctcccatcatcaatatttattgagcatttacagtgtactaggcacaatagaacatacagaaaacattgtccctgctcttgaggagcttacattctaaaagaaaaaatacaccttttttaaaatggcatttttgtttggtgttttctgcaaagtactgaggaaatattttgtaaagtgagctttgggtataacttagccccatcattatttagagaatagaggaggaagaaagaggaaggattttaaaggcagacaatgacagaccattcaggataggtagggttttaaagggagataaacacagtctcatcaactaaggagagatttgctgcagtaaataggatgagggaaatagtctgtgggatgcaagcaaaggaagcagggtgccttagacactgagtggagccagaaagatcatgcggcctttttccaagtacatggccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaattttaaatggaacacactacatttttttctaatcaatccccccctctcccagaaaaaataggaactcatttttttcagggtggggaggaagagaggggatcatgggacatggaaacagtagttatattagtagtatttttgttatgataaattttgtgtttaaacttggtaagagcccattagctgccaagagggaataaggaataaatttcaaaaaatgtacaatttcctttagagaagtttcagaaccaagactaatttacatgaaaagctgtagagaaagtagttgaaaagtccattcataaaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcaaaaaaaaaaaaatcacaaaagcaaaaatcctaaaaaaaagttaaatacatgggtttttgttttactgctgtgcttgatatacatgaagtaatgaataccaagcaattcatttttcctgcatctttacttttacatttgttcttaggttgcctaaaacatttaaatacaaataaaatgagtgtagcaaaaataatgaaagctaacagcaggtaactttacaaataatggaatgtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtaggcagttttctttgcttagacatggaagcagttttacactggcccttttgaagccacaatgtaccaaaagtactatgccaaacacttataacttgtataaaaattccacatccccatattggccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaactggtaaaagaaggaaagatttttcagcaagtttcagtgggatgggggggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacagaaggtgaagagaaattacaagaaataatactttttttttgagatggagtctcgctctgtcaccaggctggagtgcagtggcgtgatcttggctcaatgaaccctccgcctcccaggttcaagcgattctcctgcctcagcctcctgagtagctgggactacaggcatgtgccaccacacccatctaatttttgtatttttaggagagacggggtttcactatgttggccaagatggtcttgatctgatctcgtgatccacccacctcggcctcccaaagtggtgagattacaggtgtgagccactgtgcccaggccctaaattattttttaaaaactaagcatcaataggtgtcagaacctaaagagccccaatatgaaagatggacgtccaaggtgagtgcaactataccagaagcatctaatttggcccatgctgaaggagctagggttgactactctccactggtagatcttaaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttctttttttttttttttgagacagagtctcgctcttttgcccaggctggagtgtagcggtgtgatctcagctcactgcaacctctgcctcccgggttcaagcaattctcttcctcagcctcccgagtagctgggattacaggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacatacaaatcaactgcattgtggactgaatttgaatcccaattcaaataacttaaaaaaagagagataattggaattcaagtattatttagatattcaaacattattagggaattatgttgatgttcctggtgtgatagtgacactgtttctttttatacatctgcagtatcccaaggacaatcacgacctttcatattaagtcatttaaaataagaagctaggcaaaatagacttccacttggattctgtagatacctgagattttgtaactcaagttattaattccctaccattatctttaccaatatggaggcaacttgatgggcaagaaaatcattcttaaaggaactaaaacatgtagagtctcagcacacttttgatactaacaaattttaacaagacaggtaactcatcaatgtgtgtattttttagttctcagtctaatatttcagtttctgtaattttccttcataggactttaatagtagctgagatatatttatgagagcctatgaaatgtgttgagaaaaaattttaaaagatgtatttaataaaaaaaaaaattccctagagtaaaacataacctcttcaaccacattcatcactaatgatgctgttatgtacttactgtcaagttgtctctcagtaattgcattattagcgtgctgtctttgtatgactcttcacttaatgtatcaagttcagcaatggcttcatcaaaagcctacgatttaaaaatagtacattacatttcagtgctcaaataataaagactgctaaatttctacgtaacaggtaaaatacatactgtctttgcaagagagcaggctttctctggggagttcagaatctcataatagaacacagagaagttaagggccagacccagtctgataggatgtgttggttgcatttcctttttgctgatttcaaaagcttcttggtatgcttgttgtgactgatcgacaatccctggataagacacaccaaaacgtactgagataaagtgtgcattatatcttcacccctcaaaccaaacctttaatatctcacatatcctttgaaatactaacctgtaacagcttaatatttgttaattgaacaaggtccttttttttttttaaagggagctttctcctggtacacactagccattgatcaatgtcaagataaaacaactttataatctcattattgttatgtttttaaaaaattgacgagttttgacatcccagacccaagcaatcctcccacctcagcctccagattagctgggaccaaaggcttgcaccaccatgcccagctaattttcaaaatattttttgtagagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaacttaaacacccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaacttcatttataacaacacaattcaagcaaacctcacaacagataaaaaaaccgttcaaaagttttatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaattttttttttttttttttttacaactcaagctacagataacccagatgaagtggcagtagggccagattgcactgtgctatataaagaggttaaaggtgagaaaagtcaacctgaaatgatgtttcctgcaattattaaccgatatttaaaaatactggcctgaggccgggcacagtggctcatgccagtaatcccagcactctgggaggctagggtggcaggatcacttgaggtgagcctcgtcaacatggtgaaaccctgtctctactaaaaatacaaaaattagccaggcgtggtgacgggcgcctgtaatcccagctgaggcaggagaactgcttgagcccgagagatagaggctgcagtgagccgaggttgcaccactgcactgcagcctggatgacagagcaagactccatctcaaaataaataaaaataaaataaaattactggccggaaatcagaagaacgttttggttaggatagcaacctctgtcttacaccacattcatactttcatattcaaagttctcttagctgcaaaagtgttttgtcctttgaatacaatgctttttaccacctatggttgctctgtggagatctgcctcaaacagtggaagacacttgcatttaaaatagtcaagtgagtctttccacttaaaaacaatggttttaagaaacaaatgaccaggattttcaaaagtttcattgttacacaaattgtattattcattcaactatgggagatggtataaacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaaattttatttctattatcacaataacaccagacaccatgctagaagctggaagcacaatattctggtaattcataatctagctgtagagacaaggctatcattccttccattacaatacactttacaagaattgcagggcacggtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacgtctttcacttttcggtaactttaaccccctctatgtatgcagagatgaaggccataaacacatgcagttacttaagagtgaaccagtcacttaagatgtaaaattttaaagctgtactaaaaacttaaatttttttaggaaaggtgttgataaatgctactaaaagtagtaatctatcttttgtaggtagtaactttctacctgggtaatatgctgaactaagcagttccctgggaattaaaatggcagttaagcacttctttccccaaagctgaacactgaattaaccataaaacaactttaaagctatttgttagaacccacaagtaacaggagggctgggtaaacagcagtcaggctgcttactggcctaatgatagaccaaaagaaccaaacaagtggcaagtgtttctggtgagatgctgaccataagagttgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagtgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagccaggcgtggtggcacacgcctggaatcccaggtactcaggaggctgaggcaggagaatcacttgaacccgggaggcagaggttgcagtgagctgagattgcgccattgcactccagcctgggcaacaagagtgaaactccgtcttaaaaagaaaaaaaaaaaaaggaacatattctcagcctcaatggggtgatatacctactagaaaggacgttattccacaatcaggaatcaaagttatggcgagtatactagaaactgtcaggataatggaaagaacaggacatgaatggctccaagagacaagaccaattaaatttagcaagagggaagatttctgttcagtatgagaaaacttatgagtggtccagtactggaacctgctcagtgaattccctcttttcacataaaggtaaaacaggaaactaaagagggtaacttaggtattttgtagaggagattcataaagaagatgtcatctgtttcttttaaaaaaattttaattgacaaaatagttgtaaatattttgggggtgcatgtgatattgatacatgcatacaatatataatgatcaaatcagagtaactgggatatccatcacctcaaacattgattttttttttttttttttgagacagtcttgctctggcacccaggctggggtgcagtggcgcaatgtcggctcactgcaacctcctcctcctgagttcaagcgtttctcctgccttggcctcctgagtagctgggattacaggcatgtgccaccatacccagctaacttttgtatctttagtaccaatggggtttcgccatgttggccaggctggtcttgaacttctgacttcaggtgatccacctgcctcagcctcccaaagtgctgggaatacaggcgtaaagccactgcacctggcctcaaacattgatcttctatttgtgttaggagcactgcaattcttctagctactttggtagaataaataaatgttaactataatttccctactgtactattgaatactagaacttatttctactatctaaccggatttttgtacacgtggtctttttcaattctaagggaagtcagagttcacagaattaatttaatggtaacataaaagaggcaattaagtatgttgctttgtcaaactgaccgaagaataacaaatccaagttttccagatttggaagccagaagataaaacccaatgtaggaagaatagaaaaaaatgaataaaagaacaaaagaaaaaggaagcagcagttacaacaaagcagaaaaaaacatggaggtgcaccaagtagagaatggaagggaggaaagggctgatagctactttcaaaatatgcaataacttcagagaatatcctgctcaacacagaaataaacctcctaaatttcgttcacctacaatagtacaatgaaagcaatcatgactgaaataaagtctgaagtaaaaaggggagggagtgggcacaccataatataaggaagtatacactaagtgtcacaatttcaaccgtatttagaacgaagtctcgctctgtcgcccaggctggagttcagtggtgtgatcttggctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcagcctcccaaagtgctgggattacaggtgtgagccaccgcgcccagccaactccaactgtaaaacaagggctaggttgactgaaggttcaacttgtaaaatttttcaattatcacagtaccttaagtttttaaaccaaatctaaatggttttgaggtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggccccatcatagcttgccctgctcccattaacttttaaatatgttttttcatgacagccactgtcttttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctgacattcaaaaatctgctttagtgctcttgtactcttaagtacatcattttggctttggtaatctaaaatttgtataactaggaaaaatggtgaagtaggatgcaaaaaagttttcattcaaaaacacaggattaagacatatcaaagaacaaaagaaaaaagaacaaaagaaaaaaagaacatttcctttagtatttattttctctttttaaacaacagacttgttaggaacacaaactatggagacagactgcttactgcctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctctgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctcaattcatttaagatatttgtcgaatacctaggtctgaatacccacagcttatctgcctgcagttctttgaagaaaaaagtgttccataaaaaaagaaaagcagctagtttatctcacaattcaaataactgcaagtgtttttcttagagacaaccactggacttcccattttgcctcactgaaagatgtctatttaagggctattaataaaataatgtttcagattcaaggacattaaaaaaaaagtcttttttctttttaaaagaaacagtgagtgcataatggtaaagaaatacaataatcactagtacagtatagtatcactgccttgattagcgataaggaaccagtaagtttgagcaacccttgggtttgcaccagtgctaaatgtcaacaaagtgataagaatcagtattaacagtatttgccatgaaaatagttgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgcggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagactcgtctcaaaaaaaaaaaaaaaaaaaaaaaaaaaaattagcctagtgtagtgtgcacttgcactcccagctactccaaaggctgagatgggaggatcacttgagcacaggatgtcatggctgcagtgagtgcaccactgcactccagcatgggggacagagggagaccctatcttttttttttttttttaaaaggagggtctggctaagtaagttgctacatacccaaataatagaatactatacagacattaagagtgaggaggtacgggctggttgtggtggctcacgcctgtaatcccacactttaggaggccaaggtgggtggatcacctgaggtcaggagttcgagaccagcctggctaacatggcgaaactccgtctctactaaaaatacaaaaattagctgggtgtggtggcaggcgcctgtaatcccagctactcaggagactgagacagaagaatcacttgaacccaggaggcagaggttgtgccatctgcactccaacctgggcgatagggcgagactgtctccaaaaaacaaaagagtaaggaggtacctgtcaaaatgaaacataagatatacatcaaagtgtgtagttttgtacaatttaccaaactaagtatatgatccttattcttcaaggacagaattgtttactttgcacataaattcccaggatacacaaaggactaacagagattacctccaagaaggcaggatgaggttacagcagctttattttttccttctacatgctatgctcttaacacctaaattcttaggagcaagtacaatttaaaataaagattaccagcctgggtgacaccccgtctctactgggaaaaaaaaaaaaattggatgtggtggcacacgactgtaatcccagctactcgggaggctgagccaggagaattgcttgaatgaacccgggaggcagaggttgcagtgagccgacattgtgccactgcactccaatgagttagactccatctcaaataaaacaaacaattatggttttgcacctttaacttttcacacacatatatactcttaacctactcataggctctaataaaggcacgttctacacattttaagcactcaaaaatattaaactccctgactgaataatatacgcataactgtaatagcttcatttaaataaaacattttaaaactatcttggaggatattttaatagctcaacatcctaaaaactatttttcagaaagtcttcatcatcaagagtgtattaccttaccaaattcctaaatagttaagacaaaacctgatagaaattcaggttgacactacattcaataatgaatattctgctgtaagagacacaacaatgttctacttctctgaaaacctaagagattgctcatttaaaatatgtgagtgctgaactaaacacatatattcagaaacagcagcaaaggggcaggctaagcacctcctaatatggataagctccaggtttctatgtaatgaacaaagaagaacctaagaaaaatcctgcagagagaactggaagagagtgtgaggttgcaaggcagagtaaacttgttaagaagtcaagggtcctagattatggtactaattctactaactaagaggcaagacaggcatttcaaatacaaaactatgaccagcctcctcctcaccttaatcttcttgtgtttcactacagcattaatttcaaaatctcccttccaatgccaggaaatctcctctaacataatgaatttcccaccccaccactatcccttacatttctttaaattcaagatcactttttttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaactagaacacaagaagccaactaatgaaaataaattcgaaaaaaaattacaagttacagagctgggatcctattttcccctttgaagaagcaacctattcagtataaacagaggcagcttatttaaaaagcactttggcaaaataatttagtttgtaacctttgacaaagtaatcataatcttaaggcatataccttaaaaaagattcaatgggtattttgcaccatggggtgtgttttcagaagtcctaacagcataatgcactatctaaatataattggttaagtaacaggacaacaccacatgcctcctaatataatgcagtgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaacaagactgatccacattaaaggagagtaaggagacatgtaagcaaaatgcaaagtgtaattctggatggaattctggagcagaaacaggaaattacagtaaaacaatttgctaaatttaattaagattataggttacataatagtttatcatttactttaatcattttcctgattttaataattatactgtagttattaacatgtggacaatctggcaaaatatatgaaaaactcttcatatttttccaacctctttctaaatctgaaattatttcaaaatgaaaagttaatacattttaaagaagtcccttttaattgtctttatttctgaaagataccctttttcataccctttatatgctttttttttttcaaatttccttatgtggctgatactacttttgtatttaacacagaaatggtacaaaaacaatgatacatttgtaaagaaaaatatgtggggtggagagaaagttctcatcttgtcttaaaacagtatttcaccaactggtcctaatattaaatttaattcgcacaaagataattagacatcgagtgtcattagcaaatagcaaatccccccagaatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcagtaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaacaagagtcaaactccatctcaaacaacaaaaaaaccccactgttttcaataaaattaaagccacttattttgttattctgacaactcctcatccccccctacaaacccagtatcttgatagcagattaaatgtcatgtttcaatctacaataagatgatactacattaagagactacaaatattaatgcttactgtatgacctcatgtaaatagctgaacccctgagctgcagtgtcttgatctgttaaaataaaaaggctagatcagatgtccctttaaccctaaaattcaatgactcaatgaaatttctgtatacttaaacatatttctacaaatctataaattatgtaaaactcccagtttatattattcaatttaaaaactcacaaaaataccccacaaatgtcattttaataacatcctcattaatagatttaattccaactcttcagcatagtgtagttcaaatttctggtcttgtacaattctcttatgcagagataattttcctataatttttattctgtagagacactgggccttgtataaatcctagatctcttaaaattttaaaaagaaatcatgcaagaagcccataatctgtcacacattaggggcccatagatttaatctcttactcccccttgtggccggagtggcttccattctttgatttgcaatttcctcacttgctttcaaccaattagaaaagtgctccaccagaaatgctaatgattaggaggtgtcaagaactaatttattaagtcttttagacattttgactttaaattattacctttctatgcaatgtggcctaacagaataagattttaagctgtgaacatatgttctataaataaggtcatctataagcaggcttgtgcctaatcacttaacgcattttccattaatagatggcaaatctgcacttttaatcaacaagaaatctggcaaagcaagatgttcctgatgttcaagaactgttaaagccagcctaaaactttattaatataattcctgttaaaagagtagctgctccctgatatttaccccaaaacaaaagatacctacactaaacaatgctgatagaaagccccatctgttctgttctaaaactttttttttttaatcaactgggtgaaagggctagcaggaagtgagaataaaaactgccaaattaaatcaggttcagagaattgtctccctccgaatcatgaatgctagcaaaataatcctagaaggaatcagtgttttaagaacatctaacgctgggcacggtggctcacacctgtaatcaatcccactttggaggccgaggcgggtggatcatctgaggtcaggagttcaagaccagccttaccaacatggagaaaccccatctctactaaaatacaaaaatcagctgggcgtggtggtgcatgcctgtaatcccagctactcaggaggccgaggcaggagaatcgcttgaacccaggagacggaggatgtggtgagccaagatcacgccattgcactccagcctgggcaacaagagtgaaactccatctcaaaaaaaataaaaataaaaaaaggaacatctgaaaacaaattttgaaatgttgttcctaaagattaaaagtgaaatactaggccaggtgcagtggctcatgcctgtaatctcagcactttgggaggccgaggcaggcggatcacgaggttaggagatcgagaccaacctggctaacctggtgaaacctcatctctactaaaaaatacaaaagaattagccgggcgtggtggcggccacctgtagtcccagctactagggaggctgagacaggagaatggtgtgaacctggaaggcggagcttgcagtgagccgagatcgcgccactgcactccagcctgggggacagagcgagactccgcgccactgcactccagcctgggggacagagcgagactccgtctcaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttggtggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttcagctttctaaagttctcttaaatttaatccaaaatttataaatgaaaccacaataaagtgatatcacagaggtacaaaaggtaaagcagtgtatttgctatttaacaccaccacaggggtgtgttaattcaacaatttcctcaaaacatcctagaggtagatagtattattcccattttgaagatgtggaaacagagtcacagacaaatgcagtaaaacttgccccaaatcacacaatgaatcaaaaattcaaaaagactgcatggctcatgctaagttttatcacctctcttaaagtaaggtagtatacactttagtatcctttatttttagaaatgttacacagggatatgcttaaagttttatctctgctccaattaaagaaaaagagcctgatgctagtcctccattagatggcaacaatcaaagggcaactgggaaggaaaagtcgttactcttacaaaaagcagattgcttgagttgtcttatttctaaacatcttcctaacacaatgctaaaggactcatcaaattgttgaattgagaacttgcctgttctaggcaagaactacagcttgcctatataatactaccttcaactgtcaattccacagaatcacattttaagtaggtattttgcataatattttcatcaagtgtctcttggttgaatgtggtccaagtatgtcattctaaactggacaatgtttattacgtttaaggagcaaaaaaattataagctgagtgttcataagtcttggatcaacaaataggtctgtctcagaaaagcgtttgtaattaatcacttagatgagaaacattccgcataccagtgggttccttggtataacgctaatttttaaaaactctagatcccaaaaattgtttgcaagttagaaattaactgccactaaaaaacatttctaggccgggtatggtggctcacgactgtaatcccagcactttgggaggccggggtgggtggatcacctgaggtcaggagttcaagaccagcccggccaacatggcgaaaccccgtctctactaaaaatacaaaaattagccaggcatggtggtgggcgcctgtagtcccagctacctgggaggctgaggagggagaatcgcttgaacccggaaggtggaggctgcagtgaggcgagattgtgccactgcactccagcctggacgacaaggtgagactgctatctcagaaaaaaacaaaacaaaaaacgacaaaaaaaaaaaaaaacatctctaacttcccaactcattaaacgattaaaataaaatactaatacaacaaaaattgggcagtccctgcaaatttaatgcaataatccttcttagattttaaaattcaacacatgcatacaggccaacccattaagcaaatcttatgttggtccgcttaactttatagattaatacttggctgaaactatccttatattcttttacctgttgttaccactgtaagcacatttttatttggggaaggaaggctcacaacaaatcctgtcaaaagaaatccacaagagcttacatgctgaaactttttaataacctatccaatgtaaacaaaagggcaggtgtcacacaaaatgatcttactgatatcaagtcagctatattcatccacatggctttggtgcctgaatggcaatagaaaaaaaaactagtgaaatctgccaatatgtaaaactctatcctacactacactactacttctatcacattataccttaccagaaaacaaaactaaatcaatgacaactgctattgcacagtaactttcacatatacaagcttttcataattaaatggaattactgactagagaacaagtgaatgatcggttacatagaaatacacataataaaaaagagagaactgctgatacgaccgttcttcccacaccaaaatttacatttgtgccatctaaatatcaaagcatatactccttcagtgtactttacaaatacacaaatgttttcaaggagaaaagaacagagccaatcttctgatgctgaaagacagataatcaagattaaaataagtcctaaatcgagtaatgaagcagaaaccctcaggccataaagatggtaattagcaacagtttgtatcagggatagtgagacgaccaaactaaagctaaaagcctcttgcagggaattctggcaaggatcaagcaaatagatggaatgaaatcagcattttagaaagattagaataagaaatacatgcaacatagaactgaaaaaggaaaaataagagtaacaagtccaagtgaatgaccacaagcagcagtaaaaagatgtttataatttagcttttgtccattaaaagcacatcaagtttatccatacagtatcattttcctatttggcaatgtgcacttttctgagtataatcctgggaactatacaattcagcgtgaatgtaaaggatagggaaccaatgatatgggaaacatcaacagcttgtaatctgaaaattaagtcaaagttgagtccaacatgtcgtgtgattaagtctagaaaacatgctaaaattgggtagttataaagaacaggcagtttcaaaaggaaaaggaatgctggctttgagtatattgaaactgacagcagttctaagtcccctaaaaccttgagcggtgtttattctctatgtggaactgtcaagagtaaagcaaaagctatgggaactagaatgaaatcacaatagggaaccaggaattctacaaaaaattctaagaaacttattagaatttcaataaactatatgctaacttttaaaacttacttgatatcagaacacctgtcattctgacttaaaaattctcacacacacattcaatataaatatgccaagagtaacttattttggaatcaaaaatttgagaaattaatccaaaagtccaatgacatttaattcagtattataaagacagagctagtttcccttcccatcaaacagcaaaggcctctacacctttccattccctttcctttattttcatcatttccacttcatatacctcagactttttgtatttgtacaaaatatgtcattgggtgtggcactttacattaaaaaaaactgaactttattaccaaagacactgtccaggccgggcgcggtggctcacgcctgtaatcccagcactttgggaggccgaggcaggtggatcacgaggtcaggagaccaagaccatcttggctaacacggtgaaaccccatctctactaaaaatacaatacaattagctgggtgtggtggcgggcacctgtagtcccagctactcgggaggctgaggcaggagaatggcgtgagcccggaaggcagagcttgcagtgagccgagatcgttccattgcactccagcctaggcgacagagcaagactccgtctcaaaaaaaaaaagaaaaaagaaaaaaagaaaaaaaagacactgtccaattttttccttcctgagaccacagaactgggattatttatactttgaaacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctgagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagagacccctgcactattataggcaggctcacacttttaaatagaactgaaaagctaagataaacaggacacagaaggtagtcaaggtgctttacctgactctcattccccacaaccctgtgggatgagtattattcctatttaattgagcttagttttctcagagggactgagtgatttcctcaggccatgcatctattaaatggtaaaactagtttgactcagtatcttgagctccattattcacctcgacatacttctttgagtttgaaagaggcttcctagactgtatttccttggtattcatttcatcatgtgcaagataaaaactacccaatttttggctgccatctttcaggtttaaagaggtactagtgttgagtccctccccaactaccaagagagcttttgtctaagcatctggcaggaaaggcagattgcattagttcacatattgcagtttgaaattaacacgtggaagagaagaaacccaagttcttttacataatgcaaagtccacattgtgaagagcatgccagtgaccacttcccgccataatgctctatttactcttgtaatatgcaacatggtccaagctctttgcttattaaatggttaaacaatagataaatacatataaccagaatgggttactaaagagctcttcagaaaaactcagaactttggagattagctgctttttgtaggaagaaagtttattttcatagctattataaaataggtgctcaatataaaaaatctggttatcactaatgccacaagccaatactattatttctgcaaagggacacctgcttatttttctcaaattaaaaaatatatatatcaaagcccagaaaaggctggagtaataaaaaattataattgattttttatcatgtaagatcttaaaaatataatttaaaatatttttactaatcattaataatgattcaataactttttctagtagaaatatcagttctgctacattttattcttccatctcacagaaagggcagaaggaattttatgcaatatgtttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaagtttcttcataaggaaactaaagggaagcatagtcaaaactgctacaagttgggctggacgtggtggctcactcctgtaatcccagcactttgggaggccaaggcgagtggatcacctgaggtcaagagttagacgtgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagcaaaaaaaaaaaacaaaaaaaacaaaaaaacccaatacattttttattatagaaaaaaaaaatcacattttcaaaatttaaatatttggccgggcgcggtggctcaagcctgtaatcccagcactttgggaggctgaggagggcggatcacgaggtcaggagatcgagaccatcctggctaacatggtgaaaccccgtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatagtagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaaggttcatatagtaagtaacaaacctggatttccatactgagttccagattcagtaatctgtccagaaaaatcgagatgctgcccctctttgtatatcagagcccttccatactggttaagtgtaaccatttagtaaaaccactttaaatattattccaaaaactgccagcttggttggattctctactggtttatcctcaaatttaaactattcttgatcaaaaagccctactttatatgacagattaaaattaaccaaaatgtagtttaattcttttaagcgcagtgcttcaacacagtaagtactgaatacttaaaatactcgattcaaactggaaaatcaagcttgagttgttcataacctttcatcatggttgtgagtgttcaaaatttaccttcaagaattcaatgcaggaagaggtttcatagttgtgacgccagagttttctgcatggttgactcattacattaacattatagcggctaatcctgagaagagtactatttctacaatgagtatcctattacatctctcttacctaaagtatgtaaaattcctttatccacagatgtacatttaagataaccagctatagagctactacaaatattctaaccataagtaaaacagtaacacaattagtttatattttcaattaatataaaatacaatactaaagtctgttatttttaacaaaactgaactgtttcataatcattgttgcaattattttacatacacgtatctataattgtcttaacatctttttagtcatgacaccatgaagacttttaaatttggaacacacaatgtttagaaggaaaagaaaaaccaaacaaaaagttaagagtaatgtaactgatactcatagggaccctacagtataatgaagccagactgaattgattctcaccagtacatcattgcagatatctcttagctccgtctcaattttctctctgtattctcgagccatctgctgttttttctcagcaccttccgtcttttgttcaatacttgagacgaccctccaagatgacctacgggctcctacaacatttttataagcaactgagagaagattcctctcctcattggataattcagctccttgctcagttacagacttcatgcaggctgccatgtcatcatatcgctcagcctgctcggccagtttggccttctgaaccagctcatttttatccatgactggatgttctgcaggggggaaaaaaggagtatttaaaatttttcccatcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttcctttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatcttgttatatgtccacatgctttaaaaatatccgcaagtcatgacacttcaactcttactgtgagtactagaatatatcacattggaagtacttaatttataagtgtttccaatgtcatcgctccagttgaaatgcagaagtgctgcattttgcttctagccatcataatgtaattggatgttaccactcaagctgtcctttaccatgactacccatctaattctctttccctcgcattttagtttcctggaccttttcgatttacctcagctacatttttctggaaagatacccttttgcaagttgccgaacagcacaaagatactaatccacacagtgacaccacagaataaatgacttcagaggaaaatacacaccctgaatgaagtgcacttttaagttagaaggtgaacagaagagtccaccttggcagctggctcccgaatattaatcatcttttaccttcccagggaaatcccacaatatttttttaaccaaatgagagaacaggtcgccacattttaaacaaataattaaccactttggatgcaaggtactggctcaatacgtaaactatttaacctttatgacggcattattttcgtcaggtctctaaattactgatttttcccttaggatctcagaaacgctctctggttatttctgcttctaacaaaaaatgatttaagccagtacaaaggattctctccccaatcacttcggtacaagaggaagtggataaggtttctcacacagtaacgagtgctccaaggcctcgcctctacactgcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtcagggagcccaacctactgcagagtgttaattcctccccccgaccggagccagagggaggagcagcccgcgcccccgcccaagccgtgggggggggggagagatggggagcgaagccgcccgaccccggggcagagacgccacagcagcccgcagaagcggaaccactaccagccccgccgcggacacaccccgctctcccacccagcgccttccccgccaccgatcagcgccggtgaccgtgtacagcgtctctaagggaccgacagctgcaggtgggggaggggacgagagccacacccagccgagcgggccaccagcggctatgctcaggctcacccgcccccaaagcaggatatgcgtccccaaaccgagcgcagggaccctccagttctagtccatcaagcacgggagccgactgcgggctcaccaccctgttctctaccccgacctggacttgcagcccccgtccacacctcccccgcccgttcacaaggagcaaaaaaagtcagacccatcccccacccccaccaggaaaattcaagtccttcctcccaccgcggagcccaggaaattcagctctaggtcccaggcgagccccaccccaaaacctcaccccgcagtggactcccctcccgccggcgcgcagcctcgccccggtctacctggcgggcgccgccgcgccaggcctgggctccggcccgctctcggccaggcctttccctcgcgcttgggtccccgaggcccccggcccctccccgccgcgccaccgcctcccggggtgggggagggccgggtcccgccgccgcagcgcccagcgcggaggctgcgcgagggggagggaaaggagggggcggccgagggagaggggagggggcggcctcacctgcgccactgcgatgcccgccgccgccgccgccgagtcattatctcgggcggaagcgagaagggcggcgagggagggggtggaagcccgcagagacaagggtggggatggatcgcggccggcggcgccccggccatgcctcgtccaccttcgggagccggcgacagggagatccccagggatctcgcgtgtgggcgccctacccacccccgggggcaggacgggggagcgagcaccgatcggcgccggggcgtcgatgcggaagcaaggagccggaggcggccgctagccgccctcccgagcccagcggaagaggagccgccgcccgtgtccgctgaggagactccgcctcagcccggcgccgccaccgcggggcgagtggggatgaggggacggagcgaggacggctcccacgcgttcggaaggctggcctgggacaggaagcgaggcgcggcggcggccgggttcctcacctgtgtccggagtgggtggtggcggcggacggacgggctcagcagtctctgggcggcggcggcggcagcagcggcgaggctgagactctgtccctggatctcgctgctcacaggctacagccgctccgcagacacggggtttcctccaatcaccagccccggcagcaggggcaccacacgcacgatgacgtcaaacgctgctatggcaaccgttgattggtgcccacagcgatcggggccccgcgtaaccgccgctccccggcgctcgtcctgcccgcccgcgctggagggcgagcggaggcgcgcgcgtcctcgcccgcagccgccactcctcccaccccgctcggcttccagctcctctacgcttgtcccgagtgcacctagggcaggaggctgcttttttccttttcctccccaacgcaaatcccccactcctcgccttccctttgggtccccaacgccctctctctccctctcccctgcagcctctgccggcccactcttcctctcagccggcgggaaggcgttctctccctacccccaccttagctttcgctcagcccgtctgcgcttgccccagtcactccctctggaaggggctcccgttcagcaacatccgggacctttcacatccccccacccctccccgaggcccggcccgccccaccctccgtgcttcgcggtagtaactgccccagggccgtccccgggcaggatgacaagggtggctcggcggctccggcattgtgatcaggacttgcggggcgggggccccggggcgggggcagggcgcggtcgcacggcaagggagggttgtgtgtggtgcgctgccccccgccccgcccgccgctccccttccccggctgggccgaccggggcgcgcggcccctcccggcctccctcccgccgccgcggctttacctgctggctcgggggaagcggtcctagaccttttatggctcggaaacgggagtgaggcgtccagcccctgagtgtggctgagtgatggggaggcgttccaatcgagagcgcgggatctgcgctcggtgactgcgcgaggggaca

SEQ ID NO: 2169 - DNA, 32757 bp, Homo sapiens
tctccattgcacttttatttgaatgtaatatttgggacaattattcaaaagggccaatatttcccaatttaatctgaggtcataataaaacaagcaacaaaacagtgtttgggatttcagtttctcacccttatcatcaagactcactgcctcccatcatcaatatttattgagcatttacagtgtactaggcacaatagaacatacagaaaacattgtccctgctcttgaggagcttacattctaaaagaaaaaatacaccttttttaaaatggcatttttgtttggtgttttctgcaaagtactgaggaaatattttgtaaagtgagctttgggtataacttagccccatcattatttagagaatagaggaggaagaaagaggaaggattttaaaggcagacaatgacagaccattcaggataggtagggttttaaagggagataaacacagtctcatcaactaaggagagatttgctgcagtaaataggatgagggaaatagtctgtgggatgcaagcaaaggaagcagggtgccttagacactgagtggagccagaaagatcatgcggcctttttccaagtacatggccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaattttaaatggaacacactacatttttttctaatcaatccccccctctcccagaaaaaataggaactcatttttttcagggtggggaggaagagaggggatcatgggacatggaaacagtagttatattagtagtatttttgttatgataaattttgtgtttaaacttggtaagagcccattagctgccaagagggaataaggaataaatttcaaaaaatgtacaatttcctttagagaagtttcagaaccaagactaatttacatgaaaagctgtagagaaagtagttgaaaagtccattcataaaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcaaaaaaaaaaaaatcacaaaagcaaaaatcctaaaaaaaagttaaatacatgggtttttgttttactgctgtgcttgatatacatgaagtaatgaataccaagcaattcatttttcctgcatctttacttttacatttgttcttaggttgcctaaaacatttaaatacaaataaaatgagtgtagcaaaaataatgaaagctaacagcaggtaactttacaaataatggaatgtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtaggcagttttctttgcttagacatggaagcagttttacactggcccttttgaagccacaatgtaccaaaagtactatgccaaacacttataacttgtataaaaattccacatccccatattggccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaactggtaaaagaaggaaagatttttcagcaagtttcagtgggatgggggggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacagaaggtgaagagaaattacaagaaataatactttttttttgagatggagtctcgctctgtcaccaggctggagtgcagtggcgtgatcttggctcaatgaaccctccgcctcccaggttcaagcgattctcctgcctcagcctcctgagtagctgggactacaggcatgtgccaccacacccatctaatttttgtatttttaggagagacggggtttcactatgttggccaagatggtcttgatctgatctcgtgatccacccacctcggcctcccaaagtggtgagattacaggtgtgagccactgtgcccaggccctaaattattttttaaaaactaagcatcaataggtgtcagaacctaaagagccccaatatgaaagatggacgtccaaggtgagtgcaactataccagaagcatctaatttggcccatgctgaaggagctagggttgactactctccactggtagatcttaaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttctttttttttttttttgagacagagtctcgctcttttgcccaggctggagtgtagcggtgtgatctcagctcactgcaacctctgcctcccgggttcaagcaattctcttcctcagcctcccgagtagctgggattacaggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacatacaaatcaactgcattgtggactgaatttgaatcccaattcaaataacttaaaaaaagagagataattggaattcaagtattatttagatattcaaacattattagggaattatgttgatgttcctggtgtgatagtgacactgtttctttttatacatctgcagtatcccaaggacaatcacgacctttcatattaagtcatttaaaataagaagctaggcaaaatagacttccacttggattctgtagatacctgagattttgtaactcaagttattaattccctaccattatctttaccaatatggaggcaacttgatgggcaagaaaatcattcttaaaggaactaaaacatgtagagtctcagcacacttttgatactaacaaattttaacaagacaggtaactcatcaatgtgtgtattttttagttctcagtctaatatttcagtttctgtaattttccttcataggactttaatagtagctgagatatatttatgagagcctatgaaatgtgttgagaaaaaattttaaaagatgtatttaataaaaaaaaaaattccctagagtaaaacataacctcttcaaccacattcatcactaatgatgctgttatgtacttactgtcaagttgtctctcagtaattgcattattagcgtgctgtctttgtatgactcttcacttaatgtatcaagttcagcaatggcttcatcaaaagcctacgatttaaaaatagtacattacatttcagtgctcaaataataaagactgctaaatttctacgtaacaggtaaaatacatactgtctttgcaagagagcaggctttctctggggagttcagaatctcataatagaacacagagaagttaagggccagacccagtctgataggatgtgttggttgcatttcctttttgctgatttcaaaagcttcttggtatgcttgttgtgactgatcgacaatccctggataagacacaccaaaacgtactgagataaagtgtgcattatatcttcacccctcaaaccaaacctttaatatctcacatatcctttgaaatactaacctgtaacagcttaatatttgttaattgaacaaggtccttttttttttttaaagggagctttctcctggtacacactagccattgatcaatgtcaagataaaacaactttataatctcattattgttatgtttttaaaaaattgacgagttttgacatcccagacccaagcaatcctcccacctcagcctccagattagctgggaccaaaggcttgcaccaccatgcccagctaattttcaaaatattttttgtagagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaacttaaacacccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaacttcatttataacaacacaattcaagcaaacctcacaacagataaaaaaaccgttcaaaagttttatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaattttttttttttttttttttacaactcaagctacagataacccagatgaagtggcagtagggccagattgcactgtgctatataaagaggttaaaggtgagaaaagtcaacctgaaatgatgtttcctgcaattattaaccgatatttaaaaatactggcctgaggccgggcacagtggctcatgccagtaatcccagcactctgggaggctagggtggcaggatcacttgaggtgagcctcgtcaacatggtgaaaccctgtctctactaaaaatacaaaaattagccaggcgtggtgacgggcgcctgtaatcccagctgaggcaggagaactgcttgagcccgagagatagaggctgcagtgagccgaggttgcaccactgcactgcagcctggatgacagagcaagactccatctcaaaataaataaaaataaaataaaattactggccggaaatcagaagaacgttttggttaggatagcaacctctgtcttacaccacattcatactttcatattcaaagttctcttagctgcaaaagtgttttgtcctttgaatacaatgctttttaccacctatggttgctctgtggagatctgcctcaaacagtggaagacacttgcatttaaaatagtcaagtgagtctttccacttaaaaacaatggttttaagaaacaaatgaccaggattttcaaaagtttcattgttacacaaattgtattattcattcaactatgggagatggtataaacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaaattttatttctattatcacaataacaccagacaccatgctagaagctggaagcacaatattctggtaattcataatctagctgtagagacaaggctatcattccttccattacaatacactttacaagaattgcagggcacggtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacgtctttcacttttcggtaactttaaccccctctatgtatgcagagatgaaggccataaacacatgcagttacttaagagtgaaccagtcacttaagatgtaaaattttaaagctgtactaaaaacttaaatttttttaggaaaggtgttgataaatgctactaaaagtagtaatctatcttttgtaggtagtaactttctacctgggtaatatgctgaactaagcagttccctgggaattaaaatggcagttaagcacttctttccccaaagctgaacactgaattaaccataaaacaactttaaagctatttgttagaacccacaagtaacaggagggctgggtaaacagcagtcaggctgcttactggcctaatgatagaccaaaagaaccaaacaagtggcaagtgtttctggtgagatgctgaccataagagttgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagtgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagccaggcgtggtggcacacgcctggaatcccaggtactcaggaggctgaggcaggagaatcacttgaacccgggaggcagaggttgcagtgagctgagattgcgccattgcactccagcctgggcaacaagagtgaaactccgtcttaaaaagaaaaaaaaaaaaaggaacatattctcagcctcaatggggtgatatacctactagaaaggacgttattccacaatcaggaatcaaagttatggcgagtatactagaaactgtcaggataatggaaagaacaggacatgaatggctccaagagacaagaccaattaaatttagcaagagggaagatttctgttcagtatgagaaaacttatgagtggtccagtactggaacctgctcagtgaattccctcttttcacataaaggtaaaacaggaaactaaagagggtaacttaggtattttgtagaggagattcataaagaagatgtcatctgtttcttttaaaaaaattttaattgacaaaatagttgtaaatattttgggggtgcatgtgatattgatacatgcatacaatatataatgatcaaatcagagtaactgggatatccatcacctcaaacattgattttttttttttttttttgagacagtcttgctctggcacccaggctggggtgcagtggcgcaatgtcggctcactgcaacctcctcctcctgagttcaagcgtttctcctgccttggcctcctgagtagctgggattacaggcatgtgccaccatacccagctaacttttgtatctttagtaccaatggggtttcgccatgttggccaggctggtcttgaacttctgacttcaggtgatccacctgcctcagcctcccaaagtgctgggaatacaggcgtaaagccactgcacctggcctcaaacattgatcttctatttgtgttaggagcactgcaattcttctagctactttggtagaataaataaatgttaactataatttccctactgtactattgaatactagaacttatttctactatctaaccggatttttgtacacgtggtctttttcaattctaagggaagtcagagttcacagaattaatttaatggtaacataaaagaggcaattaagtatgttgctttgtcaaactgaccgaagaataacaaatccaagttttccagatttggaagccagaagataaaacccaatgtaggaagaatagaaaaaaatgaataaaagaacaaaagaaaaaggaagcagcagttacaacaaagcagaaaaaaacatggaggtgcaccaagtagagaatggaagggaggaaagggctgatagctactttcaaaatatgcaataacttcagagaatatcctgctcaacacagaaataaacctcctaaatttcgttcacctacaatagtacaatgaaagcaatcatgactgaaataaagtctgaagtaaaaaggggagggagtgggcacaccataatataaggaagtatacactaagtgtcacaatttcaaccgtatttagaacgaagtctcgctctgtcgcccaggctggagttcagtggtgtgatcttggctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcagcctcccaaagtgctgggattacaggtgtgagccaccgcgcccagccaactccaactgtaaaacaagggctaggttgactgaaggttcaacttgtaaaatttttcaattatcacagtaccttaagtttttaaaccaaatctaaatggttttgaggtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggccccatcatagcttgccctgctcccattaacttttaaatatgttttttcatgacagccactgtcttttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctgacattcaaaaatctgctttagtgctcttgtactcttaagtacatcattttggctttggtaatctaaaatttgtataactaggaaaaatggtgaagtaggatgcaaaaaagttttcattcaaaaacacaggattaagacatatcaaagaacaaaagaaaaaagaacaaaagaaaaaaagaacatttcctttagtatttattttctctttttaaacaacagacttgttaggaacacaaactatggagacagactgcttactgcctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctctgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctcaattcatttaagatatttgtcgaatacctaggtctgaatacccacagcttatctgcctgcagttctttgaagaaaaaagtgttccataaaaaaagaaaagcagctagtttatctcacaattcaaataactgcaagtgtttttcttagagacaaccactggacttcccattttgcctcactgaaagatgtctatttaagggctattaataaaataatgtttcagattcaaggacattaaaaaaaaagtcttttttctttttaaaagaaacagtgagtgcataatggtaaagaaatacaataatcactagtacagtatagtatcactgccttgattagcgataaggaaccagtaagtttgagcaacccttgggtttgcaccagtgctaaatgtcaacaaagtgataagaatcagtattaacagtatttgccatgaaaatagttgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgcggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagactcgtctcaaaaaaaaaaaaaaaaaaaaaaaaaaaaattagcctagtgtagtgtgcacttgcactcccagctactccaaaggctgagatgggaggatcacttgagcacaggatgtcatggctgcagtgagtgcaccactgcactccagcatgggggacagagggagaccctatcttttttttttttttttaaaaggagggtctggctaagtaagttgctacatacccaaataatagaatactatacagacattaagagtgaggaggtacgggctggttgtggtggctcacgcctgtaatcccacactttaggaggccaaggtgggtggatcacctgaggtcaggagttcgagaccagcctggctaacatggcgaaactccgtctctactaaaaatacaaaaattagctgggtgtggtggcaggcgcctgtaatcccagctactcaggagactgagacagaagaatcacttgaacccaggaggcagaggttgtgccatctgcactccaacctgggcgatagggcgagactgtctccaaaaaacaaaagagtaaggaggtacctgtcaaaatgaaacataagatatacatcaaagtgtgtagttttgtacaatttaccaaactaagtatatgatccttattcttcaaggacagaattgtttactttgcacataaattcccaggatacacaaaggactaacagagattacctccaagaaggcaggatgaggttacagcagctttattttttccttctacatgctatgctcttaacacctaaattcttaggagcaagtacaatttaaaataaagattaccagcctgggtgacaccccgtctctactgggaaaaaaaaaaaaattggatgtggtggcacacgactgtaatcccagctactcgggaggctgagccaggagaattgcttgaatgaacccgggaggcagaggttgcagtgagccgacattgtgccactgcactccaatgagttagactccatctcaaataaaacaaacaattatggttttgcacctttaacttttcacacacatatatactcttaacctactcataggctctaataaaggcacgttctacacattttaagcactcaaaaatattaaactccctgactgaataatatacgcataactgtaatagcttcatttaaataaaacattttaaaactatcttggaggatattttaatagctcaacatcctaaaaactatttttcagaaagtcttcatcatcaagagtgtattaccttaccaaattcctaaatagttaagacaaaacctgatagaaattcaggttgacactacattcaataatgaatattctgctgtaagagacacaacaatgttctacttctctgaaaacctaagagattgctcatttaaaatatgtgagtgctgaactaaacacatatattcagaaacagcagcaaaggggcaggctaagcacctcctaatatggataagctccaggtttctatgtaatgaacaaagaagaacctaagaaaaatcctgcagagagaactggaagagagtgtgaggttgcaaggcagagtaaacttgttaagaagtcaagggtcctagattatggtactaattctactaactaagaggcaagacaggcatttcaaatacaaaactatgaccagcctcctcctcaccttaatcttcttgtgtttcactacagcattaatttcaaaatctcccttccaatgccaggaaatctcctctaacataatgaatttcccaccccaccactatcccttacatttctttaaattcaagatcactttttttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaactagaacacaagaagccaactaatgaaaataaattcgaaaaaaaattacaagttacagagctgggatcctattttcccctttgaagaagcaacctattcagtataaacagaggcagcttatttaaaaagcactttggcaaaataatttagtttgtaacctttgacaaagtaatcataatcttaaggcatataccttaaaaaagattcaatgggtattttgcaccatggggtgtgttttcagaagtcctaacagcataatgcactatctaaatataattggttaagtaacaggacaacaccacatgcctcctaatataatgcagtgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaacaagactgatccacattaaaggagagtaaggagacatgtaagcaaaatgcaaagtgtaattctggatggaattctggagcagaaacaggaaattacagtaaaacaatttgctaaatttaattaagattataggttacataatagtttatcatttactttaatcattttcctgattttaataattatactgtagttattaacatgtggacaatctggcaaaatatatgaaaaactcttcatatttttccaacctctttctaaatctgaaattatttcaaaatgaaaagttaatacattttaaagaagtcccttttaattgtctttatttctgaaagataccctttttcataccctttatatgctttttttttttcaaatttccttatgtggctgatactacttttgtatttaacacagaaatggtacaaaaacaatgatacatttgtaaagaaaaatatgtggggtggagagaaagttctcatcttgtcttaaaacagtatttcaccaactggtcctaatattaaatttaattcgcacaaagataattagacatcgagtgtcattagcaaatagcaaatccccccagaatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcagtaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaacaagagtcaaactccatctcaaacaacaaaaaaaccccactgttttcaataaaattaaagccacttattttgttattctgacaactcctcatccccccctacaaacccagtatcttgatagcagattaaatgtcatgtttcaatctacaataagatgatactacattaagagactacaaatattaatgcttactgtatgacctcatgtaaatagctgaacccctgagctgcagtgtcttgatctgttaaaataaaaaggctagatcagatgtccctttaaccctaaaattcaatgactcaatgaaatttctgtatacttaaacatatttctacaaatctataaattatgtaaaactcccagtttatattattcaatttaaaaactcacaaaaataccccacaaatgtcattttaataacatcctcattaatagatttaattccaactcttcagcatagtgtagttcaaatttctggtcttgtacaattctcttatgcagagataattttcctataatttttattctgtagagacactgggccttgtataaatcctagatctcttaaaattttaaaaagaaatcatgcaagaagcccataatctgtcacacattaggggcccatagatttaatctcttactcccccttgtggccggagtggcttccattctttgatttgcaatttcctcacttgctttcaaccaattagaaaagtgctccaccagaaatgctaatgattaggaggtgtcaagaactaatttattaagtcttttagacattttgactttaaattattacctttctatgcaatgtggcctaacagaataagattttaagctgtgaacatatgttctataaataaggtcatctataagcaggcttgtgcctaatcacttaacgcattttccattaatagatggcaaatctgcacttttaatcaacaagaaatctggcaaagcaagatgttcctgatgttcaagaactgttaaagccagcctaaaactttattaatataattcctgttaaaagagtagctgctccctgatatttaccccaaaacaaaagatacctacactaaacaatgctgatagaaagccccatctgttctgttctaaaactttttttttttaatcaactgggtgaaagggctagcaggaagtgagaataaaaactgccaaattaaatcaggttcagagaattgtctccctccgaatcatgaatgctagcaaaataatcctagaaggaatcagtgttttaagaacatctaacgctgggcacggtggctcacacctgtaatcaatcccactttggaggccgaggcgggtggatcatctgaggtcaggagttcaagaccagccttaccaacatggagaaaccccatctctactaaaatacaaaaatcagctgggcgtggtggtgcatgcctgtaatcccagctactcaggaggccgaggcaggagaatcgcttgaacccaggagacggaggatgtggtgagccaagatcacgccattgcactccagcctgggcaacaagagtgaaactccatctcaaaaaaaataaaaataaaaaaaggaacatctgaaaacaaattttgaaatgttgttcctaaagattaaaagtgaaatactaggccaggtgcagtggctcatgcctgtaatctcagcactttgggaggccgaggcaggcggatcacgaggttaggagatcgagaccaacctggctaacctggtgaaacctcatctctactaaaaaatacaaaagaattagccgggcgtggtggcggccacctgtagtcccagctactagggaggctgagacaggagaatggtgtgaacctggaaggcggagcttgcagtgagccgagatcgcgccactgcactccagcctgggggacagagcgagactccgcgccactgcactccagcctgggggacagagcgagactccgtctcaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttggtggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttcagctttctaaagttctcttaaatttaatccaaaatttataaatgaaaccacaataaagtgatatcacagaggtacaaaaggtaaagcagtgtatttgctatttaacaccaccacaggggtgtgttaattcaacaatttcctcaaaacatcctagaggtagatagtattattcccattttgaagatgtggaaacagagtcacagacaaatgcagtaaaacttgccccaaatcacacaatgaatcaaaaattcaaaaagactgcatggctcatgctaagttttatcacctctcttaaagtaaggtagtatacactttagtatcctttatttttagaaatgttacacagggatatgcttaaagttttatctctgctccaattaaagaaaaagagcctgatgctagtcctccattagatggcaacaatcaaagggcaactgggaaggaaaagtcgttactcttacaaaaagcagattgcttgagttgtcttatttctaaacatcttcctaacacaatgctaaaggactcatcaaattgttgaattgagaacttgcctgttctaggcaagaactacagcttgcctatataatactaccttcaactgtcaattccacagaatcacattttaagtaggtattttgcataatattttcatcaagtgtctcttggttgaatgtggtccaagtatgtcattctaaactggacaatgtttattacgtttaaggagcaaaaaaattataagctgagtgttcataagtcttggatcaacaaataggtctgtctcagaaaagcgtttgtaattaatcacttagatgagaaacattccgcataccagtgggttccttggtataacgctaatttttaaaaactctagatcccaaaaattgtttgcaagttagaaattaactgccactaaaaaacatttctaggccgggtatggtggctcacgactgtaatcccagcactttgggaggccggggtgggtggatcacctgaggtcaggagttcaagaccagcccggccaacatggcgaaaccccgtctctactaaaaatacaaaaattagccaggcatggtggtgggcgcctgtagtcccagctacctgggaggctgaggagggagaatcgcttgaacccggaaggtggaggctgcagtgaggcgagattgtgccactgcactccagcctggacgacaaggtgagactgctatctcagaaaaaaacaaaacaaaaaacgacaaaaaaaaaaaaaaacatctctaacttcccaactcattaaacgattaaaataaaatactaatacaacaaaaattgggcagtccctgcaaatttaatgcaataatccttcttagattttaaaattcaacacatgcatacaggccaacccattaagcaaatcttatgttggtccgcttaactttatagattaatacttggctgaaactatccttatattcttttacctgttgttaccactgtaagcacatttttatttggggaaggaaggctcacaacaaatcctgtcaaaagaaatccacaagagcttacatgctgaaactttttaataacctatccaatgtaaacaaaagggcaggtgtcacacaaaatgatcttactgatatcaagtcagctatattcatccacatggctttggtgcctgaatggcaatagaaaaaaaaactagtgaaatctgccaatatgtaaaactctatcctacactacactactacttctatcacattataccttaccagaaaacaaaactaaatcaatgacaactgctattgcacagtaactttcacatatacaagcttttcataattaaatggaattactgactagagaacaagtgaatgatcggttacatagaaatacacataataaaaaagagagaactgctgatacgaccgttcttcccacaccaaaatttacatttgtgccatctaaatatcaaagcatatactccttcagtgtactttacaaatacacaaatgttttcaaggagaaaagaacagagccaatcttctgatgctgaaagacagataatcaagattaaaataagtcctaaatcgagtaatgaagcagaaaccctcaggccataaagatggtaattagcaacagtttgtatcagggatagtgagacgaccaaactaaagctaaaagcctcttgcagggaattctggcaaggatcaagcaaatagatggaatgaaatcagcattttagaaagattagaataagaaatacatgcaacatagaactgaaaaaggaaaaataagagtaacaagtccaagtgaatgaccacaagcagcagtaaaaagatgtttataatttagcttttgtccattaaaagcacatcaagtttatccatacagtatcattttcctatttggcaatgtgcacttttctgagtataatcctgggaactatacaattcagcgtgaatgtaaaggatagggaaccaatgatatgggaaacatcaacagcttgtaatctgaaaattaagtcaaagttgagtccaacatgtcgtgtgattaagtctagaaaacatgctaaaattgggtagttataaagaacaggcagtttcaaaaggaaaaggaatgctggctttgagtatattgaaactgacagcagttctaagtcccctaaaaccttgagcggtgtttattctctatgtggaactgtcaagagtaaagcaaaagctatgggaactagaatgaaatcacaatagggaaccaggaattctacaaaaaattctaagaaacttattagaatttcaataaactatatgctaacttttaaaacttacttgatatcagaacacctgtcattctgacttaaaaattctcacacacacattcaatataaatatgccaagagtaacttattttggaatcaaaaatttgagaaattaatccaaaagtccaatgacatttaattcagtattataaagacagagctagtttcccttcccatcaaacagcaaaggcctctacacctttccattccctttcctttattttcatcatttccacttcatatacctcagactttttgtatttgtacaaaatatgtcattgggtgtggcactttacattaaaaaaaactgaactttattaccaaagacactgtccaggccgggcgcggtggctcacgcctgtaatcccagcactttgggaggccgaggcaggtggatcacgaggtcaggagaccaagaccatcttggctaacacggtgaaaccccatctctactaaaaatacaatacaattagctgggtgtggtggcgggcacctgtagtcccagctactcgggaggctgaggcaggagaatggcgtgagcccggaaggcagagcttgcagtgagccgagatcgttccattgcactccagcctaggcgacagagcaagactccgtctcaaaaaaaaaaagaaaaaagaaaaaaagaaaaaaaagacactgtccaattttttccttcctgagaccacagaactgggattatttatactttgaaacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctgagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagagacccctgcactattataggcaggctcacacttttaaatagaactgaaaagctaagataaacaggacacagaaggtagtcaaggtgctttacctgactctcattccccacaaccctgtgggatgagtattattcctatttaattgagcttagttttctcagagggactgagtgatttcctcaggccatgcatctattaaatggtaaaactagtttgactcagtatcttgagctccattattcacctcgacatacttctttgagtttgaaagaggcttcctagactgtatttccttggtattcatttcatcatgtgcaagataaaaactacccaatttttggctgccatctttcaggtttaaagaggtactagtgttgagtccctccccaactaccaagagagcttttgtctaagcatctggcaggaaaggcagattgcattagttcacatattgcagtttgaaattaacacgtggaagagaagaaacccaagttcttttacataatgcaaagtccacattgtgaagagcatgccagtgaccacttcccgccataatgctctatttactcttgtaatatgcaacatggtccaagctctttgcttattaaatggttaaacaatagataaatacatataaccagaatgggttactaaagagctcttcagaaaaactcagaactttggagattagctgctttttgtaggaagaaagtttattttcatagctattataaaataggtgctcaatataaaaaatctggttatcactaatgccacaagccaatactattatttctgcaaagggacacctgcttatttttctcaaattaaaaaatatatatatcaaagcccagaaaaggctggagtaataaaaaattataattgattttttatcatgtaagatcttaaaaatataatttaaaatatttttactaatcattaataatgattcaataactttttctagtagaaatatcagttctgctacattttattcttccatctcacagaaagggcagaaggaattttatgcaatatgtttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaagtttcttcataaggaaactaaagggaagcatagtcaaaactgctacaagttgggctggacgtggtggctcactcctgtaatcccagcactttgggaggccaaggcgagtggatcacctgaggtcaagagttagacgtgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagcaaaaaaaaaaaacaaaaaaaacaaaaaaacccaatacattttttattatagaaaaaaaaaatcacattttcaaaatttaaatatttggccgggcgcggtggctcaagcctgtaatcccagcactttgggaggctgaggagggcggatcacgaggtcaggagatcgagaccatcctggctaacatggtgaaaccccgtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatagtagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaaggttcatatagtaagtaacaaacctggatttccatactgagttccagattcagtaatctgtccagaaaaatcgagatgctgcccctctttgtatatcagagcccttccatactggttaagtgtaaccatttagtaaaaccactttaaatattattccaaaaactgccagcttggttggattctctactggtttatcctcaaatttaaactattcttgatcaaaaagccctactttatatgacagattaaaattaaccaaaatgtagtttaattcttttaagcgcagtgcttcaacacagtaagtactgaatacttaaaatactcgattcaaactggaaaatcaagcttgagttgttcataacctttcatcatggttgtgagtgttcaaaatttaccttcaagaattcaatgcaggaagaggtttcatagttgtgacgccagagttttctgcatggttgactcattacattaacattatagcggctaatcctgagaagagtactatttctacaatgagtatcctattacatctctcttacctaaagtatgtaaaattcctttatccacagatgtacatttaagataaccagctatagagctactacaaatattctaaccataagtaaaacagtaacacaattagtttatattttcaattaatataaaatacaatactaaagtctgttatttttaacaaaactgaactgtttcataatcattgttgcaattattttacatacacgtatctataattgtcttaacatctttttagtcatgacaccatgaagacttttaaatttggaacacacaatgtttagaaggaaaagaaaaaccaaacaaaaagttaagagtaatgtaactgatactcatagggaccctacagtataatgaagccagactgaattgattctcaccagtacatcattgcagatatctcttagctccgtctcaattttctctctgtattctcgagccatctgctgttttttctcagcaccttccgtcttttgttcaatacttgagacgaccctccaagatgacctacgggctcctacaacatttttataagcaactgagagaagattcctctcctcattggataattcagctccttgctcagttacagacttcatgcaggctgccatgtcatcatatcgctcagcctgctcggccagtttggccttctgaaccagctcatttttatccatgactggatgttctgcaggggggaaaaaaggagtatttaaaatttttcccatcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttcctttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatcttgttatatgtccacatgctttaaaaatatccgcaagtcatgacacttcaactcttactgtgagtactagaatatatcacattggaagtacttaatttataagtgtttccaatgtcatcgctccagttgaaatgcagaagtgctgcattttgcttctagccatcataatgtaattggatgttaccactcaagctgtcctttaccatgactacccatctaattctctttccctcgcattttagtttcctggaccttttcgatttacctcagctacatttttctggaaagatacccttttgcaagttgccgaacagcacaaagatactaatccacacagtgacaccacagaataaatgacttcagaggaaaatacacaccctgaatgaagtgcacttttaagttagaaggtgaacagaagagtccaccttggcagctggctcccgaatattaatcatcttttaccttcccagggaaatcccacaatatttttttaaccaaatgagagaacaggtcgccacattttaaacaaataattaaccactttggatgcaaggtactggctcaatacgtaaactatttaacctttatgacggcattattttcgtcaggtctctaaattactgatttttcccttaggatctcagaaacgctctctggttatttctgcttctaacaaaaaatgatttaagccagtacaaaggattctctccccaatcacttcggtacaagaggaagtggataaggtttctcacacagtaacgagtgctccaaggcctcgcctctacactgcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtcagggagcccaacctactgcagagtgttaattcctccccccgaccggagccagagggaggagcagcccgcgcccccgcccaagccgtgggggggggggagagatggggagcgaagccgcccgaccccggggcagagacgccacagcagcccgcagaagcggaaccactaccagccccgccgcggacacaccccgctctcccacccagcgccttccccgccaccgatcagcgccggtgaccgtgtacagcgtctctaagggaccgacagctgcaggtgggggaggggacgagagccacacccagccgagcgggccaccagcggctatgctcaggctcacccgcccccaaagcaggatatgcgtccccaaaccgagcgcagggaccctccagttctagtccatcaagcacgggagccgactgcgggctcaccaccctgttctctaccccgacctggacttgcagcccccgtccacacctcccccgcccgttcacaaggagcaaaaaaagtcagacccatcccccacccccaccaggaaaattcaagtccttcctcccaccgcggagcccaggaaattcagctctaggtcccaggcgagccccaccccaaaacctcaccccgcagtggactcccctcccgccggcgcgcagcctcgccccggtctacctggcgggcgccgccgcgccaggcctgggctccggcccgctctcggccaggcctttccctcgcgcttgggtccccgaggcccccggcccctccccgcc

SEQ ID NO: 2170 - DNA, 32757 bp, Homo sapiens; identical to SEQ ID NO: 2169

SEQ ID NO: 2171 - DNA, 31996 bp, Homo sapiens
tctccattgcacttttatttgaatgtaatatttgggacaattattcaaaagggccaatatttcccaatttaatctgaggtcataataaaacaagcaacaaaacagtgtttgggatttcagtttctcacccttatcatcaagactcactgcctcccatcatcaatatttattgagcatttacagtgtactaggcacaatagaacatacagaaaacattgtccctgctcttgaggagcttacattctaaaagaaaaaatacaccttttttaaaatggcatttttgtttggtgttttctgcaaagtactgaggaaatattttgtaaagtgagctttgggtataacttagccccatcattatttagagaatagaggaggaagaaagaggaaggattttaaaggcagacaatgacagaccattcaggataggtagggttttaaagggagataaacacagtctcatcaactaaggagagatttgctgcagtaaataggatgagggaaatagtctgtgggatgcaagcaaaggaagcagggtgccttagacactgagtggagccagaaagatcatgcggcctttttccaagtacatggccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaattttaaatggaacacactacatttttttctaatcaatccccccctctcccagaaaaaataggaactcatttttttcagggtggggaggaagagaggggatcatgggacatggaaacagtagttatattagtagtatttttgttatgataaattttgtgtttaaacttggtaagagcccattagctgccaagagggaataaggaataaatttcaaaaaatgtacaatttcctttagagaagtttcagaaccaagactaatttacatgaaaagctgtagagaaagtagttgaaaagtccattcataaaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcaaaaaaaaaaaaatcacaaaagcaaaaatcctaaaaaaaagttaaatacatgggtttttgttttactgctgtgcttgatatacatgaagtaatgaataccaagcaattcatttttcctgcatctttacttttacatttgttcttaggttgcctaaaacatttaaatacaaataaaatgagtgtagcaaaaataatgaaagctaacagcaggtaactttacaaataatggaatgtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtaggcagttttctttgcttagacatggaagcagttttacactggcccttttgaagccacaatgtaccaaaagtactatgccaaacacttataacttgtataaaaattccacatccccatattggccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaactggtaaaagaaggaaagatttttcagcaagtttcagtgggatgggggggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacagaaggtgaagagaaattacaagaaataatactttttttttgagatggagtctcgctctgtcaccaggctggagtgcagtggcgtgatcttggctcaatgaaccctccgcctcccaggttcaagcgattctcctgcctcagcctcctgagtagctgggactacaggcatgtgccaccacacccatctaatttttgtatttttaggagagacggggtttcactatgttggccaagatggtcttgatctgatctcgtgatccacccacctcggcctcccaaagtggtgagattacaggtgtgagccactgtgcccaggccctaaattattttttaaaaactaagcatcaataggtgtcagaacctaaagagccccaatatgaaagatggacgtccaaggtgagtgcaactataccagaagcatctaatttggcccatgctgaaggagctagggttgactactctccactggtagatcttaaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttctttttttttttttttgagacagagtctcgctcttttgcccaggctggagtgtagcggtgtgatctcagctcactgcaacctctgcctcccgggttcaagcaattctcttcctcagcctcccgagtagctgggattacaggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacatacaaatcaactgcattgtggactgaatttgaatcccaattcaaataacttaaaaaaagagagataattggaattcaagtattatttagatattcaaacattattagggaattatgttgatgttcctggtgtgatagtgacactgtttctttttatacatctgcagtatcccaaggacaatcacgacctttcatattaagtcatttaaaataagaagctaggcaaaatagacttccacttggattctgtagatacctgagattttgtaactcaagttattaattccctaccattatctttaccaatatggaggcaacttgatgggcaagaaaatcattcttaaaggaactaaaacatgtagagtctcagcacacttttgatactaacaaattttaacaagacaggtaactcatcaatgtgtgtattttttagttctcagtctaatatttcagtttctgtaattttccttcataggactttaatagtagctgagatatatttatgagagcctatgaaatgtgttgagaaaaaattttaaaagatgtatttaataaaaaaaaaaattccctagagtaaaacataacctcttcaaccacattcatcactaatgatgctgttatgtacttactgtcaagttgtctctcagtaattgcattattagcgtgctgtctttgtatgactcttcacttaatgtatcaagttcagcaatggcttcatcaaaagcctacgatttaaaaatagtacattacatttcagtgctcaaataataaagactgctaaatttctacgtaacaggtaaaatacatactgtctttgcaagagagcaggctttctctggggagttcagaatctcataatagaacacagagaagttaagggccagacccagtctgataggatgtgttggttgcatttcctttttgctgatttcaaaagcttcttggtatgcttgttgtgactgatcgacaatccctggataagacacaccaaaacgtactgagataaagtgtgcattatatcttcacccctcaaaccaaacctttaatatctcacatatcctttgaaatactaacctgtaacagcttaatatttgttaattgaacaaggtccttttttttttttaaagggagctttctcctggtacacactagccattgatcaatgtcaagataaaacaactttataatctcattattgttatgtttttaaaaaattgacgagttttgacatcccagacccaagcaatcctcccacctcagcctccagattagctgggaccaaaggcttgcaccaccatgcccagctaattttcaaaatattttttgtagagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaacttaaacacccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaacttcatttataacaacacaattcaagcaaacctcacaacagataaaaaaaccgttcaaaagttttatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaattttttttttttttttttttacaactcaagctacagataacccagatgaagtggcagtagggccagattgcactgtgctatataaagaggttaaaggtgagaaaagtcaacctgaaatgatgtttcctgcaattattaaccgatatttaaaaatactggcctgaggccgggcacagtggctcatgccagtaatcccagcactctgggaggctagggtggcaggatcacttgaggtgagcctcgtcaacatggtgaaaccctgtctctactaaaaatacaaaaattagccaggcgtggtgacgggcgcctgtaatcccagctgaggcaggagaactgcttgagcccgagagatagaggctgcagtgagccgaggttgcaccactgcactgcagcctggatgacagagcaagactccatctcaaaataaataaaaataaaataaaattactggccggaaatcagaagaacgttttggttaggatagcaacctctgtcttacaccacattcatactttcatattcaaagttctcttagctgcaaaagtgttttgtcctttgaatacaatgctttttaccacctatggttgctctgtggagatctgcctcaaacagtggaagacacttgcatttaaaatagtcaagtgagtctttccacttaaaaacaatggttttaagaaacaaatgaccaggattttcaaaagtttcattgttacacaaattgtattattcattcaactatgggagatggtataaacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaaattttatttctattatcacaataacaccagacaccatgctagaagctggaagcacaatattctggtaattcataatctagctgtagagacaaggctatcattccttccattacaatacactttacaagaattgcagggcacggtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacgtctttcacttttcggtaactttaaccccctctatgtatgcagagatgaaggccataaacacatgcagttacttaagagtgaaccagtcacttaagatgtaaaattttaaagctgtactaaaaacttaaatttttttaggaaaggtgttgataaatgctactaaaagtagtaatctatcttttgtaggtagtaactttctacctgggtaatatgctgaactaagcagttccctgggaattaaaatggcagttaagcacttctttccccaaagctgaacactgaattaaccataaaacaactttaaagctatttgttagaacccacaagtaacaggagggctgggtaaacagcagtcaggctgcttactggcctaatgatagaccaaaagaaccaaacaagtggcaagtgtttctggtgagatgctgaccataagagttgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagtgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagccaggcgtggtggcacacgcctggaatcccaggtactcaggaggctgaggcaggagaatcacttgaacccgggaggcagaggttgcagtgagctgagattgcgccattgcactccagcctgggcaacaagagtgaaactccgtcttaaaaagaaaaaaaaaaaaaggaacatattctcagcctcaatggggtgatatacctactagaaaggacgttattccacaatcaggaatcaaagttatggcgagtatactagaaactgtcaggataatggaaagaacaggacatgaatggctccaagagacaagaccaattaaatttagcaagagggaagatttctgttcagtatgagaaaacttatgagtggtccagtactggaacctgctcagtgaattccctcttttcacataaaggtaaaacaggaaactaaagagggtaacttaggtattttgtagaggagattcataaagaagatgtcatctgtttcttttaaaaaaattttaattgacaaaatagttgtaaatattttgggggtgcatgtgatattgatacatgcatacaatatataatgatcaaatcagagtaactgggatatccatcacctcaaacattgattttttttttttttttttgagacagtcttgctctggcacccaggctggggtgcagtggcgcaatgtcggctcactgcaacctcctcctcctgagttcaagcgtttctcctgccttggcctcctgagtagctgggattacaggcatgtgccaccatacccagctaacttttgtatctttagtaccaatggggtttcgccatgttggccaggctggtcttgaacttctgacttcaggtgatccacctgcctcagcctcccaaagtgctgggaatacaggcgtaaagccactgcacctggcctcaaacattgatcttctatttgtgttaggagcactgcaattcttctagctactttggtagaataaataaatgttaactataatttccctactgtactattgaatactagaacttatttctactatctaaccggatttttgtacacgtggtctttttcaattctaagggaagtcagagttcacagaattaatttaatggtaacataaaagaggcaattaagtatgttgctttgtcaaactgaccgaagaataacaaatccaagttttccagatttggaagccagaagataaaacccaatgtaggaagaatagaaaaaaatgaataaaagaacaaaagaaaaaggaagcagcagttacaacaaagcagaaaaaaacatggaggtgcaccaagtagagaatggaagggaggaaagggctgatagctactttcaaaatatgcaataacttcagagaatatcctgctcaacacagaaataaacctcctaaatttcgttcacctacaatagtacaatgaaagcaatcatgactgaaataaagtctgaagtaaaaaggggagggagtgggcacaccataatataaggaagtatacactaagtgtcacaatttcaaccgtatttagaacgaagtctcgctctgtcgcccaggctggagttcagtggtgtgatcttggctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcagcctcccaaagtgctgggattacaggtgtgagccaccgcgcccagccaactccaactgtaaaacaagggctaggttgactgaaggttcaacttgtaaaatttttcaattatcacagtaccttaagtttttaaaccaaatctaaatggttttgaggtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggccccatcatagcttgccctgctcccattaacttttaaatatgttttttcatgacagccactgtcttttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctgacattcaaaaatctgctttagtgctcttgtactcttaagtacatcattttggctttggtaatctaaaatttgtataactaggaaaaatggtgaagtaggatgcaaaaaagttttcattcaaaaacacaggattaagacatatcaaagaacaaaagaaaaaagaacaaaagaaaaaaagaacatttcctttagtatttattttctctttttaaacaacagacttgttaggaacacaaactatggagacagactgcttactgcctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctctgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctcaattcatttaagatatttgtcgaatacctaggtctgaatacccacagcttatctgcctgcagttctttgaagaaaaaagtgttccataaaaaaagaaaagcagctagtttatctcacaattcaaataactgcaagtgtttttcttagagacaaccactggacttcccattttgcctcactgaaagatgtctatttaagggctattaataaaataatgtttcagattcaaggacattaaaaaaaaagtcttttttctttttaaaagaaacagtgagtgcataatggtaaagaaatacaataatcactagtacagtatagtatcactgccttgattagcgataaggaaccagtaagtttgagcaacccttgggtttgcaccagtgctaaatgtcaacaaagtgataagaatcagtattaacagtatttgccatgaaaatagttgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgcggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagactcgtctcaaaaaaaaaaaaaaaaaaaaaaaaaaaaattagcctagtgtagtgtgcacttgcactcccagctactccaaaggctgagatgggaggatcacttgagcacaggatgtcatggctgcagtgagtgcaccactgcactccagcatgggggacagagggagaccctatcttttttttttttttttaaaaggagggtctggctaagtaagttgctacatacccaaataatagaatactatacagacattaagagtgaggaggtacgggctggttgtggtggctcacgcctgtaatcccacactttaggaggccaaggtgggtggatcacctgaggtcaggagttcgagaccagcctggctaacatggcgaaactccgtctctactaaaaatacaaaaattagctgggtgtggtggcaggcgcctgtaatcccagctactcaggagactgagacagaagaatcacttgaacccaggaggcagaggttgtgccatctgcactccaacctgggcgatagggcgagactgtctccaaaaaacaaaagagtaaggaggtacctgtcaaaatgaaacataagatatacatcaaagtgtgtagttttgtacaatttaccaaactaagtatatgatccttattcttcaaggacagaattgtttactttgcacataaattcccaggatacacaaaggactaacagagattacctccaagaaggcaggatgaggttacagcagctttattttttccttctacatgctatgctcttaacacctaaattcttaggagcaagtacaatttaaaataaagattaccagcctgggtgacaccccgtctctactgggaaaaaaaaaaaaattggatgtggtggcacacgactgtaatcccagctactcgggaggctgagccaggagaattgcttgaatgaacccgggaggcagaggttgcagtgagccgacattgtgccactgcactccaatgagttagactccatctcaaataaaacaaacaattatggttttgcacctttaacttttcacacacatatatactcttaacctactcataggctctaataaaggcacgttctacacattttaagcactcaaaaatattaaactccctgactgaataatatacgcataactgtaatagcttcatttaaataaaacattttaaaactatcttggaggatattttaatagctcaacatcctaaaaactatttttcagaaagtcttcatcatcaagagtgtattaccttaccaaattcctaaatagttaagacaaaacctgatagaaattcaggttgacactacattcaataatgaatattctgctgtaagagacacaacaatgttctacttctctgaaaacctaagagattgctcatttaaaatatgtgagtgctgaactaaacacatatattcagaaacagcagcaaaggggcaggctaagcacctcctaatatggataagctccaggtttctatgtaatgaacaaagaagaacctaagaaaaatcctgcagagagaactggaagagagtgtgaggttgcaaggcagagtaaacttgttaagaagtcaagggtcctagattatggtactaattctactaactaagaggcaagacaggcatttcaaatacaaaactatgaccagcctcctcctcaccttaatcttcttgtgtttcactacagcattaatttcaaaatctcccttccaatgccaggaaatctcctctaacataatgaatttcccaccccaccactatcccttacatttctttaaattcaagatcactttttttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaactagaacacaagaagccaactaatgaaaataaattcgaaaaaaaattacaagttacagagctgggatcctattttcccctttgaagaagcaacctattcagtataaacagaggcagcttatttaaaaagcactttggcaaaataatttagtttgtaacctttgacaaagtaatcataatcttaaggcatataccttaaaaaagattcaatgggtattttgcaccatggggtgtgttttcagaagtcctaacagcataatgcactatctaaatataattggttaagtaacaggacaacaccacatgcctcctaatataatgcagtgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaacaagactgatccacattaaaggagagtaaggagacatgtaagcaaaatgcaaagtgtaattctggatggaattctggagcagaaacaggaaattacagtaaaacaatttgctaaatttaattaagattataggttacataatagtttatcatttactttaatcattttcctgattttaataattatactgtagttattaacatgtggacaatctggcaaaatatatgaaaaactcttcatatttttccaacctctttctaaatctgaaattatttcaaaatgaaaagttaatacattttaaagaagtcccttttaattgtctttatttctgaaagataccctttttcataccctttatatgctttttttttttcaaatttccttatgtggctgatactacttttgtatttaacacagaaatggtacaaaaacaatgatacatttgtaaagaaaaatatgtggggtggagagaaagttctcatcttgtcttaaaacagtatttcaccaactggtcctaatattaaatttaattcgcacaaagataattagacatcgagtgtcattagcaaatagcaaatccccccagaatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcagtaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaacaagagtcaaactccatctcaaacaacaaaaaaaccccactgttttcaataaaattaaagccacttattttgttattctgacaactcctcatccccccctacaaacccagtatcttgatagcagattaaatgtcatgtttcaatctacaataagatgatactacattaagagactacaaatattaatgcttactgtatgacctcatgtaaatagctgaacccctgagctgcagtgtcttgatctgttaaaataaaaaggctagatcagatgtccctttaaccctaaaattcaatgactcaatgaaatttctgtatacttaaacatatttctacaaatctataaattatgtaaaactcccagtttatattattcaatttaaaaactcacaaaaataccccacaaatgtcattttaataacatcctcattaatagatttaattccaactcttcagcatagtgtagttcaaatttctggtcttgtacaattctcttatgcagagataattttcctataatttttattctgtagagacactgggccttgtataaatcctagatctcttaaaattttaaaaagaaatcatgcaagaagcccataatctgtcacacattaggggcccatagatttaatctcttactcccccttgtggccggagtggcttccattctttgatttgcaatttcctcacttgctttcaaccaattagaaaagtgctccaccagaaatgctaatgattaggaggtgtcaagaactaatttattaagtcttttagacattttgactttaaattattacctttctatgcaatgtggcctaacagaataagattttaagctgtgaacatatgttctataaataaggtcatctataagcaggcttgtgcctaatcacttaacgcattttccattaatagatggcaaatctgcacttttaatcaacaagaaatctggcaaagcaagatgttcctgatgttcaagaactgttaaagccagcctaaaactttattaatataattcctgttaaaagagtagctgctccctgatatttaccccaaaacaaaagatacctacactaaacaatgctgatagaaagccccatctgttctgttctaaaactttttttttttaatcaactgggtgaaagggctagcaggaagtgagaataaaaactgccaaattaaatcaggttcagagaattgtctccctccgaatcatgaatgctagcaaaataatcctagaaggaatcagtgttttaagaacatctaacgctgggcacggtggctcacacctgtaatcaatcccactttggaggccgaggcgggtggatcatctgaggtcaggagttcaagaccagccttaccaacatggagaaaccccatctctactaaaatacaaaaatcagctgggcgtggtggtgcatgcctgtaatcccagctactcaggaggccgaggcaggagaatcgcttgaacccaggagacggaggatgtggtgagccaagatcacgccattgcactccagcctgggcaacaagagtgaaactccatctcaaaaaaaataaaaataaaaaaaggaacatctgaaaacaaattttgaaatgttgttcctaaagattaaaagtgaaatactaggccaggtgcagtggctcatgcctgtaatctcagcactttgggaggccgaggcaggcggatcacgaggttaggagatcgagaccaacctggctaacctggtgaaacctcatctctactaaaaaatacaaaagaattagccgggcgtggtggcggccacctgtagtcccagctactagggaggctgagacaggagaatggtgtgaacctggaaggcggagcttgcagtgagccgagatcgcgccactgcactccagcctgggggacagagcgagactccgcgccactgcactccagcctgggggacagagcgagactccgtctcaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttggtggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttcagctttctaaagttctcttaaatttaatccaaaatttataaatgaaaccacaataaagtgatatcacagaggtacaaaaggtaaagcagtgtatttgctatttaacaccaccacaggggtgtgttaattcaacaatttcctcaaaacatcctagaggtagatagtattattcccattttgaagatgtggaaacagagtcacagacaaatgcagtaaaacttgccccaaatcacacaatgaatcaaaaattcaaaaagactgcatggctcatgctaagttttatcacctctcttaaagtaaggtagtatacactttagtatcctttatttttagaaatgttacacagggatatgcttaaagttttatctctgctccaattaaagaaaaagagcctgatgctagtcctccattagatggcaacaatcaaagggcaactgggaaggaaaagtcgttactcttacaaaaagcagattgcttgagttgtcttatttctaaacatcttcctaacacaatgctaaaggactcatcaaattgttgaattgagaacttgcctgttctaggcaagaactacagcttgcctatataatactaccttcaactgtcaattccacagaatcacattttaagtaggtattttgcataatattttcatcaagtgtctcttggttgaatgtggtccaagtatgtcattctaaactggacaatgtttattacgtttaaggagcaaaaaaattataagctgagtgttcataagtcttggatcaacaaataggtctgtctcagaaaagcgtttgtaattaatcacttagatgagaaacattccgcataccagtgggttccttggtataacgctaatttttaaaaactctagatcccaaaaattgtttgcaagttagaaattaactgccactaaaaaacatttctaggccgggtatggtggctcacgactgtaatcccagcactttgggaggccggggtgggtggatcacctgaggtcaggagttcaagaccagcccggccaacatggcgaaaccccgtctctactaaaaatacaaaaattagccaggcatggtggtgggcgcctgtagtcccagctacctgggaggctgaggagggagaatcgcttgaacccggaaggtggaggctgcagtgaggcgagattgtgccactgcactccagcctggacgacaaggtgagactgctatctcagaaaaaaacaaaacaaaaaacgacaaaaaaaaaaaaaaacatctctaacttcccaactcattaaacgattaaaataaaatactaatacaacaaaaattgggcagtccctgcaaatttaatgcaataatccttcttagattttaaaattcaacacatgcatacaggccaacccattaagcaaatcttatgttggtccgcttaactttatagattaatacttggctgaaactatccttatattcttttacctgttgttaccactgtaagcacatttttatttggggaaggaaggctcacaacaaatcctgtcaaaagaaatccacaagagcttacatgctgaaactttttaataacctatccaatgtaaacaaaagggcaggtgtcacacaaaatgatcttactgatatcaagtcagctatattcatccacatggctttggtgcctgaatggcaatagaaaaaaaaactagtgaaatctgccaatatgtaaaactctatcctacactacactactacttctatcacattataccttaccagaaaacaaaactaaatcaatgacaactgctattgcacagtaactttcacatatacaagcttttcataattaaatggaattactgactagagaacaagtgaatgatcggttacatagaaatacacataataaaaaagagagaactgctgatacgaccgttcttcccacaccaaaatttacatttgtgccatctaaatatcaaagcatatactccttcagtgtactttacaaatacacaaatgttttcaaggagaaaagaacagagccaatcttctgatgctgaaagacagataatcaagattaaaataagtcctaaatcgagtaatgaagcagaaaccctcaggccataaagatggtaattagcaacagtttgtatcagggatagtgagacgaccaaactaaagctaaaagcctcttgcagggaattctggcaaggatcaagcaaatagatggaatgaaatcagcattttagaaagattagaataagaaatacatgcaacatagaactgaaaaaggaaaaataagagtaacaagtccaagtgaatgaccacaagcagcagtaaaaagatgtttataatttagcttttgtccattaaaagcacatcaagtttatccatacagtatcattttcctatttggcaatgtgcacttttctgagtataatcctgggaactatacaattcagcgtgaatgtaaaggatagggaaccaatgatatgggaaacatcaacagcttgtaatctgaaaattaagtcaaagttgagtccaacatgtcgtgtgattaagtctagaaaacatgctaaaattgggtagttataaagaacaggcagtttcaaaaggaaaaggaatgctggctttgagtatattgaaactgacagcagttctaagtcccctaaaaccttgagcggtgtttattctctatgtggaactgtcaagagtaaagcaaaagctatgggaactagaatgaaatcacaatagggaaccaggaattctacaaaaaattctaagaaacttattagaatttcaataaactatatgctaacttttaaaacttacttgatatcagaacacctgtcattctgacttaaaaattctcacacacacattcaatataaatatgccaagagtaacttattttggaatcaaaaatttgagaaattaatccaaaagtccaatgacatttaattcagtattataaagacagagctagtttcccttcccatcaaacagcaaaggcctctacacctttccattccctttcctttattttcatcatttccacttcatatacctcagactttttgtatttgtacaaaatatgtcattgggtgtggcactttacattaaaaaaaactgaactttattaccaaagacactgtccaggccgggcgcggtggctcacgcctgtaatcccagcactttgggaggccgaggcaggtggatcacgaggtcaggagaccaagaccatcttggctaacacggtgaaaccccatctctactaaaaatacaatacaattagctgggtgtggtggcgggcacctgtagtcccagctactcgggaggctgaggcaggagaatggcgtgagcccggaaggcagagcttgcagtgagccgagatcgttccattgcactccagcctaggcgacagagcaagactccgtctcaaaaaaaaaaagaaaaaagaaaaaaagaaaaaaaagacactgtccaattttttccttcctgagaccacagaactgggattatttatactttgaaacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctgagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagagacccctgcactattataggcaggctcacacttttaaatagaactgaaaagctaagataaacaggacacagaaggtagtcaaggtgctttacctgactctcattccccacaaccctgtgggatgagtattattcctatttaattgagcttagttttctcagagggactgagtgatttcctcaggccatgcatctattaaatggtaaaactagtttgactcagtatcttgagctccattattcacctcgacatacttctttgagtttgaaagaggcttcctagactgtatttccttggtattcatttcatcatgtgcaagataaaaactacccaatttttggctgccatctttcaggtttaaagaggtactagtgttgagtccctccccaactaccaagagagcttttgtctaagcatctggcaggaaaggcagattgcattagttcacatattgcagtttgaaattaacacgtggaagagaagaaacccaagttcttttacataatgcaaagtccacattgtgaagagcatgccagtgaccacttcccgccataatgctctatttactcttgtaatatgcaacatggtccaagctctttgcttattaaatggttaaacaatagataaatacatataaccagaatgggttactaaagagctcttcagaaaaactcagaactttggagattagctgctttttgtaggaagaaagtttattttcatagctattataaaataggtgctcaatataaaaaatctggttatcactaatgccacaagccaatactattatttctgcaaagggacacctgcttatttttctcaaattaaaaaatatatatatcaaagcccagaaaaggctggagtaataaaaaattataattgattttttatcatgtaagatcttaaaaatataatttaaaatatttttactaatcattaataatgattcaataactttttctagtagaaatatcagttctgctacattttattcttccatctcacagaaagggcagaaggaattttatgcaatatgtttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaagtttcttcataaggaaactaaagggaagcatagtcaaaactgctacaagttgggctggacgtggtggctcactcctgtaatcccagcactttgggaggccaaggcgagtggatcacctgaggtcaagagttagacgtgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagcaaaaaaaaaaaacaaaaaaaacaaaaaaacccaatacattttttattatagaaaaaaaaaatcacattttcaaaatttaaatatttggccgggcgcggtggctcaagcctgtaatcccagcactttgggaggctgaggagggcggatcacgaggtcaggagatcgagaccatcctggctaacatggtgaaaccccgtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatagtagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaaggttcatatagtaagtaacaaacctggatttccatactgagttccagattcagtaatctgtccagaaaaatcgagatgctgcccctctttgtatatcagagcccttccatactggttaagtgtaaccatttagtaaaaccactttaaatattattccaaaaactgccagcttggttggattctctactggtttatcctcaaatttaaactattcttgatcaaaaagccctactttatatgacagattaaaattaaccaaaatgtagtttaattcttttaagcgcagtgcttcaacacagtaagtactgaatacttaaaatactcgattcaaactggaaaatcaagcttgagttgttcataacctttcatcatggttgtgagtgttcaaaatttaccttcaagaattcaatgcaggaagaggtttcatagttgtgacgccagagttttctgcatggttgactcattacattaacattatagcggctaatcctgagaagagtactatttctacaatgagtatcctattacatctctcttacctaaagtatgtaaaattcctttatccacagatgtacatttaagataaccagctatagagctactacaaatattctaaccataagtaaaacagtaacacaattagtttatattttcaattaatataaaatacaatactaaagtctgttatttttaacaaaactgaactgtttcataatcattgttgcaattattttacatacacgtatctataattgtcttaacatctttttagtcatgacaccatgaagacttttaaatttggaacacacaatgtttagaaggaaaagaaaaaccaaacaaaaagttaagagtaatgtaactgatactcatagggaccctacagtataatgaagccagactgaattgattctcaccagtacatcattgcagatatctcttagctccgtctcaattttctctctgtattctcgagccatctgctgttttttctcagcaccttccgtcttttgttcaatacttgagacgaccctccaagatgacctacgggctcctacaacatttttataagcaactgagagaagattcctctcctcattggataattcagctccttgctcagttacagacttcatgcaggctgccatgtcatcatatcgctcagcctgctcggccagtttggccttctgaaccagctcatttttatccatgactggatgttctgcaggggggaaaaaaggagtatttaaaatttttcccatcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttcctttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatcttgttatatgtccacatgctttaaaaatatccgcaagtcatgacacttcaactcttactgtgagtactagaatatatcacattggaagtacttaatttataagtgtttccaatgtcatcgctccagttgaaatgcagaagtgctgcattttgcttctagccatcataatgtaattggatgttaccactcaagctgtcctttaccatgactacccatctaattctctttccctcgcattttagtttcctggaccttttcgatttacctcagctacatttttctggaaagatacccttttgcaagttgccgaacagcacaaagatactaatccacacagtgacaccacagaataaatgacttcagaggaaaatacacaccctgaatgaagtgcacttttaagttagaaggtgaacagaagagtccaccttggcagctggctcccgaatattaatcatcttttaccttcccagggaaatcccacaatatttttttaaccaaatgagagaacaggtcgccacattttaaacaaataattaaccactttggatgcaaggtactggctcaatacgtaaactatttaacctttatgacggcattattttcgtcaggtctctaaattactgatttttcccttaggatctcagaaacgctctctggttatttctgcttctaacaaaaaatgatttaagccagtacaaaggattctctccccaatcacttcggtacaagaggaagtggataaggtttctcacacagtaacgagtgctccaaggcctcgcctctacactgcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtc

SEQ ID NO: 2172 - DNA, 34820 bp, Homo sapiens
tctccattgcacttttatttgaatgtaatatttgggacaattattcaaaagggccaatatttcccaatttaatctgaggtcataataaaacaagcaacaaaacagtgtttgggatttcagtttctcacccttatcatcaagactcactgcctcccatcatcaatatttattgagcatttacagtgtactaggcacaatagaacatacagaaaacattgtccctgctcttgaggagcttacattctaaaagaaaaaatacaccttttttaaaatggcatttttgtttggtgttttctgcaaagtactgaggaaatattttgtaaagtgagctttgggtataacttagccccatcattatttagagaatagaggaggaagaaagaggaaggattttaaaggcagacaatgacagaccattcaggataggtagggttttaaagggagataaacacagtctcatcaactaaggagagatttgctgcagtaaataggatgagggaaatagtctgtgggatgcaagcaaaggaagcagggtgccttagacactgagtggagccagaaagatcatgcggcctttttccaagtacatggccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaattttaaatggaacacactacatttttttctaatcaatccccccctctcccagaaaaaataggaactcatttttttcagggtggggaggaagagaggggatcatgggacatggaaacagtagttatattagtagtatttttgttatgataaattttgtgtttaaacttggtaagagcccattagctgccaagagggaataaggaataaatttcaaaaaatgtacaatttcctttagagaagtttcagaaccaagactaatttacatgaaaagctgtagagaaagtagttgaaaagtccattcataaaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcaaaaaaaaaaaaatcacaaaagcaaaaatcctaaaaaaaagttaaatacatgggtttttgttttactgctgtgcttgatatacatgaagtaatgaataccaagcaattcatttttcctgcatctttacttttacatttgttcttaggttgcctaaaacatttaaatacaaataaaatgagtgtagcaaaaataatgaaagctaacagcaggtaactttacaaataatggaatgtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtaggcagttttctttgcttagacatggaagcagttttacactggcccttttgaagccacaatgtaccaaaagtactatgccaaacacttataacttgtataaaaattccacatccccatattggccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaactggtaaaagaaggaaagatttttcagcaagtttcagtgggatgggggggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacagaaggtgaagagaaattacaagaaataatactttttttttgagatggagtctcgctctgtcaccaggctggagtgcagtggcgtgatcttggctcaatgaaccctccgcctcccaggttcaagcgattctcctgcctcagcctcctgagtagctgggactacaggcatgtgccaccacacccatctaatttttgtatttttaggagagacggggtttcactatgttggccaagatggtcttgatctgatctcgtgatccacccacctcggcctcccaaagtggtgagattacaggtgtgagccactgtgcccaggccctaaattattttttaaaaactaagcatcaataggtgtcagaacctaaagagccccaatatgaaagatggacgtccaaggtgagtgcaactataccagaagcatctaatttggcccatgctgaaggagctagggttgactactctccactggtagatcttaaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttctttttttttttttttgagacagagtctcgctcttttgcccaggctggagtgtagcggtgtgatctcagctcactgcaacctctgcctcccgggttcaagcaattctcttcctcagcctcccgagtagctgggattacaggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacatacaaatcaactgcattgtggactgaatttgaatcccaattcaaataacttaaaaaaagagagataattggaattcaagtattatttagatattcaaacattattagggaattatgttgatgttcctggtgtgatagtgacactgtttctttttatacatctgcagtatcccaaggacaatcacgacctttcatattaagtcatttaaaataagaagctaggcaaaatagacttccacttggattctgtagatacctgagattttgtaactcaagttattaattccctaccattatctttaccaatatggaggcaacttgatgggcaagaaaatcattcttaaaggaactaaaacatgtagagtctcagcacacttttgatactaacaaattttaacaagacaggtaactcatcaatgtgtgtattttttagttctcagtctaatatttcagtttctgtaattttccttcataggactttaatagtagctgagatatatttatgagagcctatgaaatgtgttgagaaaaaattttaaaagatgtatttaataaaaaaaaaaattccctagagtaaaacataacctcttcaaccacattcatcactaatgatgctgttatgtacttactgtcaagttgtctctcagtaattgcattattagcgtgctgtctttgtatgactcttcacttaatgtatcaagttcagcaatggcttcatcaaaagcctacgatttaaaaatagtacattacatttcagtgctcaaataataaagactgctaaatttctacgtaacaggtaaaatacatactgtctttgcaagagagcaggctttctctggggagttcagaatctcataatagaacacagagaagttaagggccagacccagtctgataggatgtgttggttgcatttcctttttgctgatttcaaaagcttcttggtatgcttgttgtgactgatcgacaatccctggataagacacaccaaaacgtactgagataaagtgtgcattatatcttcacccctcaaaccaaacctttaatatctcacatatcctttgaaatactaacctgtaacagcttaatatttgttaattgaacaaggtccttttttttttttaaagggagctttctcctggtacacactagccattgatcaatgtcaagataaaacaactttataatctcattattgttatgtttttaaaaaattgacgagttttgacatcccagacccaagcaatcctcccacctcagcctccagattagctgggaccaaaggcttgcaccaccatgcccagctaattttcaaaatattttttgtagagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaacttaaacacccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaacttcatttataacaacacaattcaagcaaacctcacaacagataaaaaaaccgttcaaaagttttatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaattttttttttttttttttttacaactcaagctacagataacccagatgaagtggcagtagggccagattgcactgtgctatataaagaggttaaaggtgagaaaagtcaacctgaaatgatgtttcctgcaattattaaccgatatttaaaaatactggcctgaggccgggcacagtggctcatgccagtaatcccagcactctgggaggctagggtggcaggatcacttgaggtgagcctcgtcaacatggtgaaaccctgtctctactaaaaatacaaaaattagccaggcgtggtgacgggcgcctgtaatcccagctgaggcaggagaactgcttgagcccgagagatagaggctgcagtgagccgaggttgcaccactgcactgcagcctggatgacagagcaagactccatctcaaaataaataaaaataaaataaaattactggccggaaatcagaagaacgttttggttaggatagcaacctctgtcttacaccacattcatactttcatattcaaagttctcttagctgcaaaagtgttttgtcctttgaatacaatgctttttaccacctatggttgctctgtggagatctgcctcaaacagtggaagacacttgcatttaaaatagtcaagtgagtctttccacttaaaaacaatggttttaagaaacaaatgaccaggattttcaaaagtttcattgttacacaaattgtattattcattcaactatgggagatggtataaacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaaattttatttctattatcacaataacaccagacaccatgctagaagctggaagcacaatattctggtaattcataatctagctgtagagacaaggctatcattccttccattacaatacactttacaagaattgcagggcacggtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacgtctttcacttttcggtaactttaaccccctctatgtatgcagagatgaaggccataaacacatgcagttacttaagagtgaaccagtcacttaagatgtaaaattttaaagctgtactaaaaacttaaatttttttaggaaaggtgttgataaatgctactaaaagtagtaatctatcttttgtaggtagtaactttctacctgggtaatatgctgaactaagcagttccctgggaattaaaatggcagttaagcacttctttccccaaagctgaacactgaattaaccataaaacaactttaaagctatttgttagaacccacaagtaacaggagggctgggtaaacagcagtcaggctgcttactggcctaatgatagaccaaaagaaccaaacaagtggcaagtgtttctggtgagatgctgaccataagagttgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagtgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagccaggcgtggtggcacacgcctggaatcccaggtactcaggaggctgaggcaggagaatcacttgaacccgggaggcagaggttgcagtgagctgagattgcgccattgcactccagcctgggcaacaagagtgaaactccgtcttaaaaagaaaaaaaaaaaaaggaacatattctcagcctcaatggggtgatatacctactagaaaggacgttattccacaatcaggaatcaaagttatggcgagtatactagaaactgtcaggataatggaaagaacaggacatgaatggctccaagagacaagaccaattaaatttagcaagagggaagatttctgttcagtatgagaaaacttatgagtggtccagtactggaacctgctcagtgaattccctcttttcacataaaggtaaaacaggaaactaaagagggtaacttaggtattttgtagaggagattcataaagaagatgtcatctgtttcttttaaaaaaattttaattgacaaaatagttgtaaatattttgggggtgcatgtgatattgatacatgcatacaatatataatgatcaaatcagagtaactgggatatccatcacctcaaacattgattttttttttttttttttgagacagtcttgctctggcacccaggctggggtgcagtggcgcaatgtcggctcactgcaacctcctcctcctgagttcaagcgtttctcctgccttggcctcctgagtagctgggattacaggcatgtgccaccatacccagctaacttttgtatctttagtaccaatggggtttcgccatgttggccaggctggtcttgaacttctgacttcaggtgatccacctgcctcagcctcccaaagtgctgggaatacaggcgtaaagccactgcacctggcctcaaacattgatcttctatttgtgttaggagcactgcaattcttctagctactttggtagaataaataaatgttaactataatttccctactgtactattgaatactagaacttatttctactatctaaccggatttttgtacacgtggtctttttcaattctaagggaagtcagagttcacagaattaatttaatggtaacataaaagaggcaattaagtatgttgctttgtcaaactgaccgaagaataacaaatccaagttttccagatttggaagccagaagataaaacccaatgtaggaagaatagaaaaaaatgaataaaagaacaaaagaaaaaggaagcagcagttacaacaaagcagaaaaaaacatggaggtgcaccaagtagagaatggaagggaggaaagggctgatagctactttcaaaatatgcaataacttcagagaatatcctgctcaacacagaaataaacctcctaaatttcgttcacctacaatagtacaatgaaagcaatcatgactgaaataaagtctgaagtaaaaaggggagggagtgggcacaccataatataaggaagtatacactaagtgtcacaatttcaaccgtatttagaacgaagtctcgctctgtcgcccaggctggagttcagtggtgtgatcttggctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcagcctcccaaagtgctgggattacaggtgtgagccaccgcgcccagccaactccaactgtaaaacaagggctaggttgactgaaggttcaacttgtaaaatttttcaattatcacagtaccttaagtttttaaaccaaatctaaatggttttgaggtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggccccatcatagcttgccctgctcccattaacttttaaatatgttttttcatgacagccactgtcttttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctgacattcaaaaatctgctttagtgctcttgtactcttaagtacatcattttggctttggtaatctaaaatttgtataactaggaaaaatggtgaagtaggatgcaaaaaagttttcattcaaaaacacaggattaagacatatcaaagaacaaaagaaaaaagaacaaaagaaaaaaagaacatttcctttagtatttattttctctttttaaacaacagacttgttaggaacacaaactatggagacagactgcttactgcctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctctgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctcaattcatttaagatatttgtcgaatacctaggtctgaatacccacagcttatctgcctgcagttctttgaagaaaaaagtgttccataaaaaaagaaaagcagctagtttatctcacaattcaaataactgcaagtgtttttcttagagacaaccactggacttcccattttgcctcactgaaagatgtctatttaagggctattaataaaataatgtttcagattcaaggacattaaaaaaaaagtcttttttctttttaaaagaaacagtgagtgcataatggtaaagaaatacaataatcactagtacagtatagtatcactgccttgattagcgataaggaaccagtaagtttgagcaacccttgggtttgcaccagtgctaaatgtcaacaaagtgataagaatcagtattaacagtatttgccatgaaaatagttgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgcggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagactcgtctcaaaaaaaaaaaaaaaaaaaaaaaaaaaaattagcctagtgtagtgtgcacttgcactcccagctactccaaaggctgagatgggaggatcacttgagcacaggatgtcatggctgcagtgagtgcaccactgcactccagcatgggggacagagggagaccctatcttttttttttttttttaaaaggagggtctggctaagtaagttgctacatacccaaataatagaatactatacagacattaagagtgaggaggtacgggctggttgtggtggctcacgcctgtaatcccacactttaggaggccaaggtgggtggatcacctgaggtcaggagttcgagaccagcctggctaacatggcgaaactccgtctctactaaaaatacaaaaattagctgggtgtggtggcaggcgcctgtaatcccagctactcaggagactgagacagaagaatcacttgaacccaggaggcagaggttgtgccatctgcactccaacctgggcgatagggcgagactgtctccaaaaaacaaaagagtaaggaggtacctgtcaaaatgaaacataagatatacatcaaagtgtgtagttttgtacaatttaccaaactaagtatatgatccttattcttcaaggacagaattgtttactttgcacataaattcccaggatacacaaaggactaacagagattacctccaagaaggcaggatgaggttacagcagctttattttttccttctacatgctatgctcttaacacctaaattcttaggagcaagtacaatttaaaataaagattaccagcctgggtgacaccccgtctctactgggaaaaaaaaaaaaattggatgtggtggcacacgactgtaatcccagctactcgggaggctgagccaggagaattgcttgaatgaacccgggaggcagaggttgcagtgagccgacattgtgccactgcactccaatgagttagactccatctcaaataaaacaaacaattatggttttgcacctttaacttttcacacacatatatactcttaacctactcataggctctaataaaggcacgttctacacattttaagcactcaaaaatattaaactccctgactgaataatatacgcataactgtaatagcttcatttaaataaaacattttaaaactatcttggaggatattttaatagctcaacatcctaaaaactatttttcagaaagtcttcatcatcaagagtgtattaccttaccaaattcctaaatagttaagacaaaacctgatagaaattcaggttgacactacattcaataatgaatattctgctgtaagagacacaacaatgttctacttctctgaaaacctaagagattgctcatttaaaatatgtgagtgctgaactaaacacatatattcagaaacagcagcaaaggggcaggctaagcacctcctaatatggataagctccaggtttctatgtaatgaacaaagaagaacctaagaaaaatcctgcagagagaactggaagagagtgtgaggttgcaaggcagagtaaacttgttaagaagtcaagggtcctagattatggtactaattctactaactaagaggcaagacaggcatttcaaatacaaaactatgaccagcctcctcctcaccttaatcttcttgtgtttcactacagcattaatttcaaaatctcccttccaatgccaggaaatctcctctaacataatgaatttcccaccccaccactatcccttacatttctttaaattcaagatcactttttttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaactagaacacaagaagccaactaatgaaaataaattcgaaaaaaaattacaagttacagagctgggatcctattttcccctttgaagaagcaacctattcagtataaacagaggcagcttatttaaaaagcactttggcaaaataatttagtttgtaacctttgacaaagtaatcataatcttaaggcatataccttaaaaaagattcaatgggtattttgcaccatggggtgtgttttcagaagtcctaacagcataatgcactatctaaatataattggttaagtaacaggacaacaccacatgcctcctaatataatgcagtgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaacaagactgatccacattaaaggagagtaaggagacatgtaagcaaaatgcaaagtgtaattctggatggaattctggagcagaaacaggaaattacagtaaaacaatttgctaaatttaattaagattataggttacataatagtttatcatttactttaatcattttcctgattttaataattatactgtagttattaacatgtggacaatctggcaaaatatatgaaaaactcttcatatttttccaacctctttctaaatctgaaattatttcaaaatgaaaagttaatacattttaaagaagtcccttttaattgtctttatttctgaaagataccctttttcataccctttatatgctttttttttttcaaatttccttatgtggctgatactacttttgtatttaacacagaaatggtacaaaaacaatgatacatttgtaaagaaaaatatgtggggtggagagaaagttctcatcttgtcttaaaacagtatttcaccaactggtcctaatattaaatttaattcgcacaaagataattagacatcgagtgtcattagcaaatagcaaatccccccagaatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcagtaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaacaagagtcaaactccatctcaaacaacaaaaaaaccccactgttttcaataaaattaaagccacttattttgttattctgacaactcctcatccccccctacaaacccagtatcttgatagcagattaaatgtcatgtttcaatctacaataagatgatactacattaagagactacaaatattaatgcttactgtatgacctcatgtaaatagctgaacccctgagctgcagtgtcttgatctgttaaaataaaaaggctagatcagatgtccctttaaccctaaaattcaatgactcaatgaaatttctgtatacttaaacatatttctacaaatctataaattatgtaaaactcccagtttatattattcaatttaaaaactcacaaaaataccccacaaatgtcattttaataacatcctcattaatagatttaattccaactcttcagcatagtgtagttcaaatttctggtcttgtacaattctcttatgcagagataattttcctataatttttattctgtagagacactgggccttgtataaatcctagatctcttaaaattttaaaaagaaatcatgcaagaagcccataatctgtcacacattaggggcccatagatttaatctcttactcccccttgtggccggagtggcttccattctttgatttgcaatttcctcacttgctttcaaccaattagaaaagtgctccaccagaaatgctaatgattaggaggtgtcaagaactaatttattaagtcttttagacattttgactttaaattattacctttctatgcaatgtggcctaacagaataagattttaagctgtgaacatatgttctataaataaggtcatctataagcaggcttgtgcctaatcacttaacgcattttccattaatagatggcaaatctgcacttttaatcaacaagaaatctggcaaagcaagatgttcctgatgttcaagaactgttaaagccagcctaaaactttattaatataattcctgttaaaagagtagctgctccctgatatttaccccaaaacaaaagatacctacactaaacaatgctgatagaaagccccatctgttctgttctaaaactttttttttttaatcaactgggtgaaagggctagcaggaagtgagaataaaaactgccaaattaaatcaggttcagagaattgtctccctccgaatcatgaatgctagcaaaataatcctagaaggaatcagtgttttaagaacatctaacgctgggcacggtggctcacacctgtaatcaatcccactttggaggccgaggcgggtggatcatctgaggtcaggagttcaagaccagccttaccaacatggagaaaccccatctctactaaaatacaaaaatcagctgggcgtggtggtgcatgcctgtaatcccagctactcaggaggccgaggcaggagaatcgcttgaacccaggagacggaggatgtggtgagccaagatcacgccattgcactccagcctgggcaacaagagtgaaactccatctcaaaaaaaataaaaataaaaaaaggaacatctgaaaacaaattttgaaatgttgttcctaaagattaaaagtgaaatactaggccaggtgcagtggctcatgcctgtaatctcagcactttgggaggccgaggcaggcggatcacgaggttaggagatcgagaccaacctggctaacctggtgaaacctcatctctactaaaaaatacaaaagaattagccgggcgtggtggcggccacctgtagtcccagctactagggaggctgagacaggagaatggtgtgaacctggaaggcggagcttgcagtgagccgagatcgcgccactgcactccagcctgggggacagagcgagactccgcgccactgcactccagcctgggggacagagcgagactccgtctcaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttggtggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttcagctttctaaagttctcttaaatttaatccaaaatttataaatgaaaccacaataaagtgatatcacagaggtacaaaaggtaaagcagtgtatttgctatttaacaccaccacaggggtgtgttaattcaacaatttcctcaaaacatcctagaggtagatagtattattcccattttgaagatgtggaaacagagtcacagacaaatgcagtaaaacttgccccaaatcacacaatgaatcaaaaattcaaaaagactgcatggctcatgctaagttttatcacctctcttaaagtaaggtagtatacactttagtatcctttatttttagaaatgttacacagggatatgcttaaagttttatctctgctccaattaaagaaaaagagcctgatgctagtcctccattagatggcaacaatcaaagggcaactgggaaggaaaagtcgttactcttacaaaaagcagattgcttgagttgtcttatttctaaacatcttcctaacacaatgctaaaggactcatcaaattgttgaattgagaacttgcctgttctaggcaagaactacagcttgcctatataatactaccttcaactgtcaattccacagaatcacattttaagtaggtattttgcataatattttcatcaagtgtctcttggttgaatgtggtccaagtatgtcattctaaactggacaatgtttattacgtttaaggagcaaaaaaattataagctgagtgttcataagtcttggatcaacaaataggtctgtctcagaaaagcgtttgtaattaatcacttagatgagaaacattccgcataccagtgggttccttggtataacgctaatttttaaaaactctagatcccaaaaattgtttgcaagttagaaattaactgccactaaaaaacatttctaggccgggtatggtggctcacgactgtaatcccagcactttgggaggccggggtgggtggatcacctgaggtcaggagttcaagaccagcccggccaacatggcgaaaccccgtctctactaaaaatacaaaaattagccaggcatggtggtgggcgcctgtagtcccagctacctgggaggctgaggagggagaatcgcttgaacccggaaggtggaggctgcagtgaggcgagattgtgccactgcactccagcctggacgacaaggtgagactgctatctcagaaaaaaacaaaacaaaaaacgacaaaaaaaaaaaaaaacatctctaacttcccaactcattaaacgattaaaataaaatactaatacaacaaaaattgggcagtccctgcaaatttaatgcaataatccttcttagattttaaaattcaacacatgcatacaggccaacccattaagcaaatcttatgttggtccgcttaactttatagattaatacttggctgaaactatccttatattcttttacctgttgttaccactgtaagcacatttttatttggggaaggaaggctcacaacaaatcctgtcaaaagaaatccacaagagcttacatgctgaaactttttaataacctatccaatgtaaacaaaagggcaggtgtcacacaaaatgatcttactgatatcaagtcagctatattcatccacatggctttggtgcctgaatggcaatagaaaaaaaaactagtgaaatctgccaatatgtaaaactctatcctacactacactactacttctatcacattataccttaccagaaaacaaaactaaatcaatgacaactgctattgcacagtaactttcacatatacaagcttttcataattaaatggaattactgactagagaacaagtgaatgatcggttacatagaaatacacataataaaaaagagagaactgctgatacgaccgttcttcccacaccaaaatttacatttgtgccatctaaatatcaaagcatatactccttcagtgtactttacaaatacacaaatgttttcaaggagaaaagaacagagccaatcttctgatgctgaaagacagataatcaagattaaaataagtcctaaatcgagtaatgaagcagaaaccctcaggccataaagatggtaattagcaacagtttgtatcagggatagtgagacgaccaaactaaagctaaaagcctcttgcagggaattctggcaaggatcaagcaaatagatggaatgaaatcagcattttagaaagattagaataagaaatacatgcaacatagaactgaaaaaggaaaaataagagtaacaagtccaagtgaatgaccacaagcagcagtaaaaagatgtttataatttagcttttgtccattaaaagcacatcaagtttatccatacagtatcattttcctatttggcaatgtgcacttttctgagtataatcctgggaactatacaattcagcgtgaatgtaaaggatagggaaccaatgatatgggaaacatcaacagcttgtaatctgaaaattaagtcaaagttgagtccaacatgtcgtgtgattaagtctagaaaacatgctaaaattgggtagttataaagaacaggcagtttcaaaaggaaaaggaatgctggctttgagtatattgaaactgacagcagttctaagtcccctaaaaccttgagcggtgtttattctctatgtggaactgtcaagagtaaagcaaaagctatgggaactagaatgaaatcacaatagggaaccaggaattctacaaaaaattctaagaaacttattagaatttcaataaactatatgctaacttttaaaacttacttgatatcagaacacctgtcattctgacttaaaaattctcacacacacattcaatataaatatgccaagagtaacttattttggaatcaaaaatttgagaaattaatccaaaagtccaatgacatttaattcagtattataaagacagagctagtttcccttcccatcaaacagcaaaggcctctacacctttccattccctttcctttattttcatcatttccacttcatatacctcagactttttgtatttgtacaaaatatgtcattgggtgtggcactttacattaaaaaaaactgaactttattaccaaagacactgtccaggccgggcgcggtggctcacgcctgtaatcccagcactttgggaggccgaggcaggtggatcacgaggtcaggagaccaagaccatcttggctaacacggtgaaaccccatctctactaaaaatacaatacaattagctgggtgtggtggcgggcacctgtagtcccagctactcgggaggctgaggcaggagaatggcgtgagcccggaaggcagagcttgcagtgagccgagatcgttccattgcactccagcctaggcgacagagcaagactccgtctcaaaaaaaaaaagaaaaaagaaaaaaagaaaaaaaagacactgtccaattttttccttcctgagaccacagaactgggattatttatactttgaaacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctgagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagagacccctgcactattataggcaggctcacacttttaaatagaactgaaaagctaagataaacaggacacagaaggtagtcaaggtgctttacctgactctcattccccacaaccctgtgggatgagtattattcctatttaattgagcttagttttctcagagggactgagtgatttcctcaggccatgcatctattaaatggtaaaactagtttgactcagtatcttgagctccattattcacctcgacatacttctttgagtttgaaagaggcttcctagactgtatttccttggtattcatttcatcatgtgcaagataaaaactacccaatttttggctgccatctttcaggtttaaagaggtactagtgttgagtccctccccaactaccaagagagcttttgtctaagcatctggcaggaaaggcagattgcattagttcacatattgcagtttgaaattaacacgtggaagagaagaaacccaagttcttttacataatgcaaagtccacattgtgaagagcatgccagtgaccacttcccgccataatgctctatttactcttgtaatatgcaacatggtccaagctctttgcttattaaatggttaaacaatagataaatacatataaccagaatgggttactaaagagctcttcagaaaaactcagaactttggagattagctgctttttgtaggaagaaagtttattttcatagctattataaaataggtgctcaatataaaaaatctggttatcactaatgccacaagccaatactattatttctgcaaagggacacctgcttatttttctcaaattaaaaaatatatatatcaaagcccagaaaaggctggagtaataaaaaattataattgattttttatcatgtaagatcttaaaaatataatttaaaatatttttactaatcattaataatgattcaataactttttctagtagaaatatcagttctgctacattttattcttccatctcacagaaagggcagaaggaattttatgcaatatgtttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaagtttcttcataaggaaactaaagggaagcatagtcaaaactgctacaagttgggctggacgtggtggctcactcctgtaatcccagcactttgggaggccaaggcgagtggatcacctgaggtcaagagttagacgtgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagcaaaaaaaaaaaacaaaaaaaacaaaaaaacccaatacattttttattatagaaaaaaaaaatcacattttcaaaatttaaatatttggccgggcgcggtggctcaagcctgtaatcccagcactttgggaggctgaggagggcggatcacgaggtcaggagatcgagaccatcctggctaacatggtgaaaccccgtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatagtagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaaggttcatatagtaagtaacaaacctggatttccatactgagttccagattcagtaatctgtccagaaaaatcgagatgctgcccctctttgtatatcagagcccttccatactggttaagtgtaaccatttagtaaaaccactttaaatattattccaaaaactgccagcttggttggattctctactggtttatcctcaaatttaaactattcttgatcaaaaagccctactttatatgacagattaaaattaaccaaaatgtagtttaattcttttaagcgcagtgcttcaacacagtaagtactgaatacttaaaatactcgattcaaactggaaaatcaagcttgagttgttcataacctttcatcatggttgtgagtgttcaaaatttaccttcaagaattcaatgcaggaagaggtttcatagttgtgacgccagagttttctgcatggttgactcattacattaacattatagcggctaatcctgagaagagtactatttctacaatgagtatcctattacatctctcttacctaaagtatgtaaaattcctttatccacagatgtacatttaagataaccagctatagagctactacaaatattctaaccataagtaaaacagtaacacaattagtttatattttcaattaatataaaatacaatactaaagtctgttatttttaacaaaactgaactgtttcataatcattgttgcaattattttacatacacgtatctataattgtcttaacatctttttagtcatgacaccatgaagacttttaaatttggaacacacaatgtttagaaggaaaagaaaaaccaaacaaaaagttaagagtaatgtaactgatactcatagggaccctacagtataatgaagccagactgaattgattctcaccagtacatcattgcagatatctcttagctccgtctcaattttctctctgtattctcgagccatctgctgttttttctcagcaccttccgtcttttgttcaatacttgagacgaccctccaagatgacctacgggctcctacaacatttttataagcaactgagagaagattcctctcctcattggataattcagctccttgctcagttacagacttcatgcaggctgccatgtcatcatatcgctcagcctgctcggccagtttggccttctgaaccagctcatttttatccatgactggatgttctgcaggggggaaaaaaggagtatttaaaatttttcccatcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttcctttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatcttgttatatgtccacatgctttaaaaatatccgcaagtcatgacacttcaactcttactgtgagtactagaatatatcacattggaagtacttaatttataagtgtttccaatgtcatcgctccagttgaaatgcagaagtgctgcattttgcttctagccatcataatgtaattggatgttaccactcaagctgtcctttaccatgactacccatctaattctctttccctcgcattttagtttcctggaccttttcgatttacctcagctacatttttctggaaagatacccttttgcaagttgccgaacagcacaaagatactaatccacacagtgacaccacagaataaatgacttcagaggaaaatacacaccctgaatgaagtgcacttttaagttagaaggtgaacagaagagtccaccttggcagctggctcccgaatattaatcatcttttaccttcccagggaaatcccacaatatttttttaaccaaatgagagaacaggtcgccacattttaaacaaataattaaccactttggatgcaaggtactggctcaatacgtaaactatttaacctttatgacggcattattttcgtcaggtctctaaattactgatttttcccttaggatctcagaaacgctctctggttatttctgcttctaacaaaaaatgatttaagccagtacaaaggattctctccccaatcacttcggtacaagaggaagtggataaggtttctcacacagtaacgagtgctccaaggcctcgcctctacactgcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtcagggagcccaacctactgcagagtgttaattcctccccccgaccggagccagagggaggagcagcccgcgcccccgcccaagccgtgggggggggggagagatggggagcgaagccgcccgaccccggggcagagacgccacagcagcccgcagaagcggaaccactaccagccccgccgcggacacaccccgctctcccacccagcgccttccccgccaccgatcagcgccggtgaccgtgtacagcgtctctaagggaccgacagctgcaggtgggggaggggacgagagccacacccagccgagcgggccaccagcggctatgctcaggctcacccgcccccaaagcaggatatgcgtccccaaaccgagcgcagggaccctccagttctagtccatcaagcacgggagccgactgcgggctcaccaccctgttctctaccccgacctggacttgcagcccccgtccacacctcccccgcccgttcacaaggagcaaaaaaagtcagacccatcccccacccccaccaggaaaattcaagtccttcctcccaccgcggagcccaggaaattcagctctaggtcccaggcgagccccaccccaaaacctcaccccgcagtggactcccctcccgccggcgcgcagcctcgccccggtctacctggcgggcgccgccgcgccaggcctgggctccggcccgctctcggccaggcctttccctcgcgcttgggtccccgaggcccccggcccctccccgccgcgccaccgcctcccggggtgggggagggccgggtcccgccgccgcagcgcccagcgcggaggctgcgcgagggggagggaaaggagggggcggccgagggagaggggagggggcggcctcacctgcgccactgcgatgcccgccgccgccgccgccgagtcattatctcgggcggaagcgagaagggcggcgagggagggggtggaagcccgcagagacaagggtggggatggatcgcggccggcggcgccccggccatgcctcgtccaccttcgggagccggcgacagggagatccccagggatctcgcgtgtgggcgccctacccacccccgggggcaggacgggggagcgagcaccgatcggcgccggggcgtcgatgcggaagcaaggagccggaggcggccgctagccgccctcccgagcccagcggaagaggagccgccgcccgtgtccgctgaggagactccgcctcagcccggcgccgccaccgcggggcgagtggggatgaggggacggagcgaggacggctcccacgcgttcggaaggctggcctgggacaggaagcgaggcgcggcggcggccgggttcctcacctgtgtccggagtgggtggtggcggcggacggacgggctcagcagtctctgggcggcggcggcggcagcagcggcgaggctgagactctgtccctggatctcgctgctcacaggctacagccgctccgcagacacggggtttcctccaatcaccagccccggcagcaggggcaccacacgcacgatgacgtcaaacgctgctatggcaaccgttgattggtgcccacagcgatcggggccccgcgtaaccgccgctccccggcgctcgtcctgcccgcccgcgctggagggcgagcggaggcgcgcgcgtcctcgcccgcagccgccactcctcccaccccgctcggcttccagctcctctacgcttgtcccgagtgcacctagggcaggaggctgcttttttccttttcctccccaacgcaaatcccccactcctcgccttccctttgggtccccaacgccctctctctccctctcccctgcagcctctgccggcccactcttcctctcagccggcgggaaggcgttctctccctacccccaccttagctttcgctcagcccgtctgcgcttgccccagtcactccctctggaaggggctcccgttcagcaacatccgggacctttcacatccccccacccctccccgaggcccggcccgccccaccctccgtgcttcgcggtagtaactgccccagggccgtccccgggcaggatgacaagggtggctcggcggctccggcattgtgatcaggacttgcggggcgggggccccggggcgggggcagggcgcggtcgcacggcaagggagggttgtgtgtggtgcgctgccccccgccccgcccgccgctccccttccccggctgggccgaccggggcgcgcggcccctcccggcctccctcccgccgccgcggctttacctgctggctcgggggaagcggtcctagaccttttatggctcggaaacgggagtgaggcgtccagcccctgagtgtggctgagtgatggggaggcgttccaatcgagagcgcgggatctgcgctcggtgactgcgcgaggggacaatgggtgggcgccgaggtgggggcgaggtgggccgggccgggcggagccggcaggaggtgaggcctggaaggaggcgcggccgctttagggaagccagagttccgaggggaaaggacagccttctcgggcggagggctggagctggtcctggcagccttgacccggagacaggcagtcaggcgtgaccgcacggacccgtttctcgtaggctaggttttcctacccaaataaagctttcacgtgaagacctcatactgcacatgacgatcattacctttttatctcctagaagcaaggtttgagggacgtcgtagtccccagggttccagctggcggtgggagtgggccacaggccgggtgatgagccgggacgggagcccggaagaaggggaaggagaaag

SEQ ID NO: 2173 - DNA, 33554 bp, Homo sapiens
tctccattgcacttttatttgaatgtaatatttgggacaattattcaaaagggccaatatttcccaatttaatctgaggtcataataaaacaagcaacaaaacagtgtttgggatttcagtttctcacccttatcatcaagactcactgcctcccatcatcaatatttattgagcatttacagtgtactaggcacaatagaacatacagaaaacattgtccctgctcttgaggagcttacattctaaaagaaaaaatacaccttttttaaaatggcatttttgtttggtgttttctgcaaagtactgaggaaatattttgtaaagtgagctttgggtataacttagccccatcattatttagagaatagaggaggaagaaagaggaaggattttaaaggcagacaatgacagaccattcaggataggtagggttttaaagggagataaacacagtctcatcaactaaggagagatttgctgcagtaaataggatgagggaaatagtctgtgggatgcaagcaaaggaagcagggtgccttagacactgagtggagccagaaagatcatgcggcctttttccaagtacatggccaccaagtaagaatggttggtgacaagacagaaggctaaaacaggaaggtaatcttgtgcacctgacaaatagaaagaataaaggatcaaaattgaaggcaggctataagagtatcaagaaattcttaaaaaccaaaaagtgatttggaagcacaaaacttacagttaatgctacccaatgtcatgatgggccaagaacattgtggcttcctaagttagaaaatgccatatgccaaaattttaaatggaacacactacatttttttctaatcaatccccccctctcccagaaaaaataggaactcatttttttcagggtggggaggaagagaggggatcatgggacatggaaacagtagttatattagtagtatttttgttatgataaattttgtgtttaaacttggtaagagcccattagctgccaagagggaataaggaataaatttcaaaaaatgtacaatttcctttagagaagtttcagaaccaagactaatttacatgaaaagctgtagagaaagtagttgaaaagtccattcataaaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcaaaaaaaaaaaaatcacaaaagcaaaaatcctaaaaaaaagttaaatacatgggtttttgttttactgctgtgcttgatatacatgaagtaatgaataccaagcaattcatttttcctgcatctttacttttacatttgttcttaggttgcctaaaacatttaaatacaaataaaatgagtgtagcaaaaataatgaaagctaacagcaggtaactttacaaataatggaatgtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtaggcagttttctttgcttagacatggaagcagttttacactggcccttttgaagccacaatgtaccaaaagtactatgccaaacacttataacttgtataaaaattccacatccccatattggccacctcaagatgaaaacagataactccctaaatgttaactggctctactcccctaatattaaacataaaaaccacatgggaaatatagaaattcaaatagaagtaacataaacctgtcataaatcgtaaacaaaaaactatttgtgggacagcatggatgacaaatggtctactgtgtaaattttagaatgaggcagacaaaagttggaaggccggttaattttcccctccttctcctgcttcagcttcgtctccttgggtatccgatgtccacaactggtaaaagaaggaaagatttttcagcaagtttcagtgggatgggggggggggggcgttttcatataagtgccaagatacctgaatgttttagttggaaagcattcttaaaaagatagcagcatcacttagcttcaagatacaaaaacatctcaatatacaaatttactttttttgtaaccactatataagcaggttaagtacaccacagagttgccttcaaataaccttcagatacaggaaagttttggttatccacagaaggtgaagagaaattacaagaaataatactttttttttgagatggagtctcgctctgtcaccaggctggagtgcagtggcgtgatcttggctcaatgaaccctccgcctcccaggttcaagcgattctcctgcctcagcctcctgagtagctgggactacaggcatgtgccaccacacccatctaatttttgtatttttaggagagacggggtttcactatgttggccaagatggtcttgatctgatctcgtgatccacccacctcggcctcccaaagtggtgagattacaggtgtgagccactgtgcccaggccctaaattattttttaaaaactaagcatcaataggtgtcagaacctaaagagccccaatatgaaagatggacgtccaaggtgagtgcaactataccagaagcatctaatttggcccatgctgaaggagctagggttgactactctccactggtagatcttaaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccattagcttcatttatctactaagcaaatatatctctggcctggaaaggagactacttccaaggtcatacagatagccaaatgacctcttggaaactgtgtgctcctcctgtcaaacaaggggttttgtaattgcaagatgaaattgtttctaatgtctctttcctgttctaactttcaaggattcttgaattttctgtataaacatgcaaatttgatacaaaatatttctttttctagagtaatgtgttgacagtcttggtcaaccaaattcagaatgaaatattaagttttgggataatttcttttcttgacagataaatgttccaatcaacctataatggtgacagctgacactaataaggctcagagaagacatacaagtagtgacagaattagaatcaaaaccctggttttttcttttctttttttttttttttgagacagagtctcgctcttttgcccaggctggagtgtagcggtgtgatctcagctcactgcaacctctgcctcccgggttcaagcaattctcttcctcagcctcccgagtagctgggattacaggtgcccaccactatgcccagctaatttttgtatttttagtagagatggggtttcaccatcttggccaagctgttcctgaactcctgacctggtgatccgcccgcctcggcctcccaaagtgctgggattacaggcgtgagccaccacgcccggccaaccctggttttcttattgcaatatgcgctcttcatgctatactgatagcaaaattcagttggaagcagacagtagatcagggcctctcaaaaagtgatgtgaacaaaacacagtatctaggtctcaggtcatcactttaaaaatgtcatcacttcaaactagaaaagaaaaatccttaatactaaagttagttaacaaagtgcttcttatgtttgatatataagattctttcattctttactgtggcttgttatcttgactcaagtatcagaaaagtttatagatagctccaaattgtgctaataaagtaattttaggtttaataaacaagtatacaatactattcaaaaaactcttcaagattttcagcactagcatatagaactggtttatagaaaatggcagtggactagaataaagttggaagagaaatgtataaaatgagattacatagtccccaagagaaatggccctagaagtctaacaaaaaaacagtaatacctagattatgatctgcaattcctacctctttacctgacacacagcaaatgcttgataattttttcacctaagcctcaaaatttcaaatctagtatttatctgaaggagaagaatgagaagacctaagaaacaaacgagacatacaaatcaactgcattgtggactgaatttgaatcccaattcaaataacttaaaaaaagagagataattggaattcaagtattatttagatattcaaacattattagggaattatgttgatgttcctggtgtgatagtgacactgtttctttttatacatctgcagtatcccaaggacaatcacgacctttcatattaagtcatttaaaataagaagctaggcaaaatagacttccacttggattctgtagatacctgagattttgtaactcaagttattaattccctaccattatctttaccaatatggaggcaacttgatgggcaagaaaatcattcttaaaggaactaaaacatgtagagtctcagcacacttttgatactaacaaattttaacaagacaggtaactcatcaatgtgtgtattttttagttctcagtctaatatttcagtttctgtaattttccttcataggactttaatagtagctgagatatatttatgagagcctatgaaatgtgttgagaaaaaattttaaaagatgtatttaataaaaaaaaaaattccctagagtaaaacataacctcttcaaccacattcatcactaatgatgctgttatgtacttactgtcaagttgtctctcagtaattgcattattagcgtgctgtctttgtatgactcttcacttaatgtatcaagttcagcaatggcttcatcaaaagcctacgatttaaaaatagtacattacatttcagtgctcaaataataaagactgctaaatttctacgtaacaggtaaaatacatactgtctttgcaagagagcaggctttctctggggagttcagaatctcataatagaacacagagaagttaagggccagacccagtctgataggatgtgttggttgcatttcctttttgctgatttcaaaagcttcttggtatgcttgttgtgactgatcgacaatccctggataagacacaccaaaacgtactgagataaagtgtgcattatatcttcacccctcaaaccaaacctttaatatctcacatatcctttgaaatactaacctgtaacagcttaatatttgttaattgaacaaggtccttttttttttttaaagggagctttctcctggtacacactagccattgatcaatgtcaagataaaacaactttataatctcattattgttatgtttttaaaaaattgacgagttttgacatcccagacccaagcaatcctcccacctcagcctccagattagctgggaccaaaggcttgcaccaccatgcccagctaattttcaaaatattttttgtagagagagatgttgctcaggctggtcacttttcttaaaatcttgaaaaaacatccctgtacacaatattggcttttcagaaagcatttattttagaatagcagtatgaggcagtagatgtgtattctcagaacacaaagagcactgctactccttattcggcactctaagcaattcaaaacaagacattatgtacgcttcagagactcttcctcactatgttatcttatacaagttcaaccaacaggtttaaaaacagcatacctttcttgtcatcaccagcggcaacctcagccaagtaacggtagtaatctcctttcattttcaaatagaagactttgctctctgcttgtgaagcattggggatcaagaacttttccaaaagagacttaagaagaaaagaaacagacatagtgagaataaaacatttacaaaactgaaagaacttgcatttcttaaagaacaaactatagcctaagttataaaacttaaacacccagtcactgtcaatacaattgtgaatgcagctggcacatgaatttgtggtttaaagcagaatgctttgggcagcaatattttaagtttgaagttagtgttcagtttattatttgaggacaataaaattgaacattggtccctgacaatgttatctatttacatgctgacttcatgaatgtggggcatgaccgttcacatttaggaacattttctaatgagctggcaagctttccatctgaagtttcatgtggtcatgacatgaaaatagaaagaacatacgggatgaaccttttgggactctggagaaatgactaaagcagaaaccaataatgtaagacacttaaggagtccatgccagagaaggaggaacaaaataaacttcatttataacaacacaattcaagcaaacctcacaacagataaaaaaaccgttcaaaagttttatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaattttttttttttttttttttacaactcaagctacagataacccagatgaagtggcagtagggccagattgcactgtgctatataaagaggttaaaggtgagaaaagtcaacctgaaatgatgtttcctgcaattattaaccgatatttaaaaatactggcctgaggccgggcacagtggctcatgccagtaatcccagcactctgggaggctagggtggcaggatcacttgaggtgagcctcgtcaacatggtgaaaccctgtctctactaaaaatacaaaaattagccaggcgtggtgacgggcgcctgtaatcccagctgaggcaggagaactgcttgagcccgagagatagaggctgcagtgagccgaggttgcaccactgcactgcagcctggatgacagagcaagactccatctcaaaataaataaaaataaaataaaattactggccggaaatcagaagaacgttttggttaggatagcaacctctgtcttacaccacattcatactttcatattcaaagttctcttagctgcaaaagtgttttgtcctttgaatacaatgctttttaccacctatggttgctctgtggagatctgcctcaaacagtggaagacacttgcatttaaaatagtcaagtgagtctttccacttaaaaacaatggttttaagaaacaaatgaccaggattttcaaaagtttcattgttacacaaattgtattattcattcaactatgggagatggtataaacataagtggctttggggtgagtctggttttgaattacagcactatacaccgtgtgaactacttaatctcaatgattcagttatctcacctgtaaggcagagacctctaagattattgagaaaaaatacaggtaagcacttaggagtaagcacttaaaattttatttctattatcacaataacaccagacaccatgctagaagctggaagcacaatattctggtaattcataatctagctgtagagacaaggctatcattccttccattacaatacactttacaagaattgcagggcacggtggctcactcctgtaatcccaacactttgggaggctgaggtgggaggatcacttcttgagtccaggagtttgagaccaccccggtgaacatgagatcctgcctctacaaaaaaatttaaaagttaaccaggtgtggtggcacacccctatagtcccagctacttggaaggctgagacaggaggatcatctgagtccaggagtttgaggctgcagtgatctgtaattgaattataccactgtactctaggacagggtgacagtgaggctgtctcaaaaagagtaacactgcctaatcacgtctttcacttttcggtaactttaaccccctctatgtatgcagagatgaaggccataaacacatgcagttacttaagagtgaaccagtcacttaagatgtaaaattttaaagctgtactaaaaacttaaatttttttaggaaaggtgttgataaatgctactaaaagtagtaatctatcttttgtaggtagtaactttctacctgggtaatatgctgaactaagcagttccctgggaattaaaatggcagttaagcacttctttccccaaagctgaacactgaattaaccataaaacaactttaaagctatttgttagaacccacaagtaacaggagggctgggtaaacagcagtcaggctgcttactggcctaatgatagaccaaaagaaccaaacaagtggcaagtgtttctggtgagatgctgaccataagagttgagaaaggtggctgggcatggtggctcacgcctgtaatcccaacactttgggaggctgaggtgggcggatcacgaggtcaggagatcgaggccatcctggctaacaaggtgaaaccccggtctctactacaaaaagaaaaaattagccaggtgtggtggcgggcgcctgtagtcccagctactcgggagactgaggcaggagaacagtgtgaacccgggaggcggagcttgcagtgagctgagatagtgccactgcactccagcctgggcaacagagtgagactccgtctcaaaaaaaaagagttgagaaaggcataaatggcctacttctaataaatcgtccaatgacataagctaattaagatttaaaaacccaaaaccaagcaagactggattaaagattaaatttaaaggggctaacactgtagctcaaaaaaagctaactataaaagaacattttctgccaggtgtggtggttcatgcctataatcccagcactttgggaggctgaggcgggtggatcacctgaggtcaggagttcgagaccagcctggccaacacggtaaaacctcgtctctaccaaaaatacaaaaaattagccaggcgtggtggcacacgcctggaatcccaggtactcaggaggctgaggcaggagaatcacttgaacccgggaggcagaggttgcagtgagctgagattgcgccattgcactccagcctgggcaacaagagtgaaactccgtcttaaaaagaaaaaaaaaaaaaggaacatattctcagcctcaatggggtgatatacctactagaaaggacgttattccacaatcaggaatcaaagttatggcgagtatactagaaactgtcaggataatggaaagaacaggacatgaatggctccaagagacaagaccaattaaatttagcaagagggaagatttctgttcagtatgagaaaacttatgagtggtccagtactggaacctgctcagtgaattccctcttttcacataaaggtaaaacaggaaactaaagagggtaacttaggtattttgtagaggagattcataaagaagatgtcatctgtttcttttaaaaaaattttaattgacaaaatagttgtaaatattttgggggtgcatgtgatattgatacatgcatacaatatataatgatcaaatcagagtaactgggatatccatcacctcaaacattgattttttttttttttttttgagacagtcttgctctggcacccaggctggggtgcagtggcgcaatgtcggctcactgcaacctcctcctcctgagttcaagcgtttctcctgccttggcctcctgagtagctgggattacaggcatgtgccaccatacccagctaacttttgtatctttagtaccaatggggtttcgccatgttggccaggctggtcttgaacttctgacttcaggtgatccacctgcctcagcctcccaaagtgctgggaatacaggcgtaaagccactgcacctggcctcaaacattgatcttctatttgtgttaggagcactgcaattcttctagctactttggtagaataaataaatgttaactataatttccctactgtactattgaatactagaacttatttctactatctaaccggatttttgtacacgtggtctttttcaattctaagggaagtcagagttcacagaattaatttaatggtaacataaaagaggcaattaagtatgttgctttgtcaaactgaccgaagaataacaaatccaagttttccagatttggaagccagaagataaaacccaatgtaggaagaatagaaaaaaatgaataaaagaacaaaagaaaaaggaagcagcagttacaacaaagcagaaaaaaacatggaggtgcaccaagtagagaatggaagggaggaaagggctgatagctactttcaaaatatgcaataacttcagagaatatcctgctcaacacagaaataaacctcctaaatttcgttcacctacaatagtacaatgaaagcaatcatgactgaaataaagtctgaagtaaaaaggggagggagtgggcacaccataatataaggaagtatacactaagtgtcacaatttcaaccgtatttagaacgaagtctcgctctgtcgcccaggctggagttcagtggtgtgatcttggctcactgcaacctcagcctccccggttcaagtgattcttctgcctcagtctcccgagtagccgggactgcaggcacatgccatcacacccagctaatttttgtatttttagtagagacagggtttcactgcattggccaggctagtcttgaactcctgacctcatgatccacctgcctcagcctcccaaagtgctgggattacaggtgtgagccaccgcgcccagccaactccaactgtaaaacaagggctaggttgactgaaggttcaacttgtaaaatttttcaattatcacagtaccttaagtttttaaaccaaatctaaatggttttgaggtcaaacaaaattcaagcacatcctacactcaagctaaatcaaggctaaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggccccatcatagcttgccctgctcccattaacttttaaatatgttttttcatgacagccactgtcttttaaagatatcatggccaacattttagaaaatacccaagattaatttgctgaattagagttaatgcatttatacagcattcaccctaataatattaagtgggataagaaatcatttactcagcagcaaaatgccacaagaagccggtatctaatactctttggtaaacagctcctaatccagagttaaatatgtgatatgggctctgaagagaggacactaatccttaacctaaccaacaggtaaattacatgaaatttgagattttagagataaaagagatttttctctctactgcaccgtagtataattaacctcttagattgtgaaaacacttccaagagatggggttcaaataacatttttcctcccaagccagtttccaaaagatgccttaatccaaagatagtctatatttacaatgatgttttgtctttaaaattaagtctattaaaattaaggaaccacataaattgacaggtcatctgtttctgatcccttcttggcatagactcaacctgatcccactaatatgaattttataaacactcactcctgcctgtagtcaaatattcctaatgaaaagttaatgaactgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctgacattcaaaaatctgctttagtgctcttgtactcttaagtacatcattttggctttggtaatctaaaatttgtataactaggaaaaatggtgaagtaggatgcaaaaaagttttcattcaaaaacacaggattaagacatatcaaagaacaaaagaaaaaagaacaaaagaaaaaaagaacatttcctttagtatttattttctctttttaaacaacagacttgttaggaacacaaactatggagacagactgcttactgcctaaattcaaactctgtcaccttgacaaaactctgaaatcttcctgggtctcagattctcatctgtaaaaggcaaatattagtagtagacataatgcacaaggttgttgtaaggattaaatgaattaacatataataagcatttagcagagtctggcaaatagtaagcaacaaagaagtgctgccatccttttggaaggtgaaagtctagtgtcaaccacattagacttcaagtactgtttgtactgcagtaactgatcttaacccacccactcacccacccaaaaaccaccttagctctgaactccctcttatgtgaaataatttcctaatatttaagtaatattaccttatttctcccaaccatggtacatatatactacctctataaataggtacattttctaggaaaaaaccctaaacggtaacaatacttcaaatttatggcttaaaagtttgtctcaagacacttttacagtcataaaaaagtagaaaactaagatcatggtggtagtaattattttccaaagttctcatttttgctccaaagcttcaattttatctgtcaaaaatatcattttcccttaaagtgagaggctcaattcatttaagatatttgtcgaatacctaggtctgaatacccacagcttatctgcctgcagttctttgaagaaaaaagtgttccataaaaaaagaaaagcagctagtttatctcacaattcaaataactgcaagtgtttttcttagagacaaccactggacttcccattttgcctcactgaaagatgtctatttaagggctattaataaaataatgtttcagattcaaggacattaaaaaaaaagtcttttttctttttaaaagaaacagtgagtgcataatggtaaagaaatacaataatcactagtacagtatagtatcactgccttgattagcgataaggaaccagtaagtttgagcaacccttgggtttgcaccagtgctaaatgtcaacaaagtgataagaatcagtattaacagtatttgccatgaaaatagttgtgacctggctcggcgcagtggctcacacctgtaactccagcactttgggaggccgaggtgggtggatcatgaggtcaggagctcaagaccagcctggccaagatggtgaaagcctgtctctactaaaaatacaaaaattagctgggcatggtggtgtgtgcctataatcccagctactcgggaggctgagacagaagaatcacttgaacctgggaggtggatgttgcagtgagccgagattgtgccactgcactccagcctgggtaacagagtgagcctccgtctcaaaaaaaaaaaaggaagaaaatagttgtgactttttgtgatgtaatagacacctccccaaaggactcccagtggtcggcatatcacttttaacaactgatttaaagtaacctctgctatgttgtacaccttaaatatatattttttttgccaatcgtacctcaataaagctggaaaaataaaatgaaaagaatctgtgctaaatacctctccatacctagctctaatgctatgttctccctaaagctaattattcaaagctattcagcttcatctacattgtctgtacagatagtgtgtagtgtagagctttttaactgaagagaaaaaagggaaatatcctaatttctgtcaataaaggactaacggccaggtgtggtggcttatacctttaatcacaatcactttggaaggctgagctgggaggattgctggaggccaggagttagtgaccagcctaagcaatatagcaagaccccatctctactaaaaataatttaaaaacttagcctagcgtggccaggcgcggtggctaacgcctgtaatcccagcactttgggaggccgaggtgggtggatcacttgaggtcaggagttcaaaaccagcttggccatcatgttgaaaccccatctctactaaaaatacaaaaaatgaggtgggcatggtggtgcacacctgtaatcccagctacttggcaggcttgaggcaggagactcacttgaaccctggaggcggaggttgcagtgagctgagatcgtgccaaagcactccagcctgggcaacaaagctagactcgtctcaaaaaaaaaaaaaaaaaaaaaaaaaaaaattagcctagtgtagtgtgcacttgcactcccagctactccaaaggctgagatgggaggatcacttgagcacaggatgtcatggctgcagtgagtgcaccactgcactccagcatgggggacagagggagaccctatcttttttttttttttttaaaaggagggtctggctaagtaagttgctacatacccaaataatagaatactatacagacattaagagtgaggaggtacgggctggttgtggtggctcacgcctgtaatcccacactttaggaggccaaggtgggtggatcacctgaggtcaggagttcgagaccagcctggctaacatggcgaaactccgtctctactaaaaatacaaaaattagctgggtgtggtggcaggcgcctgtaatcccagctactcaggagactgagacagaagaatcacttgaacccaggaggcagaggttgtgccatctgcactccaacctgggcgatagggcgagactgtctccaaaaaacaaaagagtaaggaggtacctgtcaaaatgaaacataagatatacatcaaagtgtgtagttttgtacaatttaccaaactaagtatatgatccttattcttcaaggacagaattgtttactttgcacataaattcccaggatacacaaaggactaacagagattacctccaagaaggcaggatgaggttacagcagctttattttttccttctacatgctatgctcttaacacctaaattcttaggagcaagtacaatttaaaataaagattaccagcctgggtgacaccccgtctctactgggaaaaaaaaaaaaattggatgtggtggcacacgactgtaatcccagctactcgggaggctgagccaggagaattgcttgaatgaacccgggaggcagaggttgcagtgagccgacattgtgccactgcactccaatgagttagactccatctcaaataaaacaaacaattatggttttgcacctttaacttttcacacacatatatactcttaacctactcataggctctaataaaggcacgttctacacattttaagcactcaaaaatattaaactccctgactgaataatatacgcataactgtaatagcttcatttaaataaaacattttaaaactatcttggaggatattttaatagctcaacatcctaaaaactatttttcagaaagtcttcatcatcaagagtgtattaccttaccaaattcctaaatagttaagacaaaacctgatagaaattcaggttgacactacattcaataatgaatattctgctgtaagagacacaacaatgttctacttctctgaaaacctaagagattgctcatttaaaatatgtgagtgctgaactaaacacatatattcagaaacagcagcaaaggggcaggctaagcacctcctaatatggataagctccaggtttctatgtaatgaacaaagaagaacctaagaaaaatcctgcagagagaactggaagagagtgtgaggttgcaaggcagagtaaacttgttaagaagtcaagggtcctagattatggtactaattctactaactaagaggcaagacaggcatttcaaatacaaaactatgaccagcctcctcctcaccttaatcttcttgtgtttcactacagcattaatttcaaaatctcccttccaatgccaggaaatctcctctaacataatgaatttcccaccccaccactatcccttacatttctttaaattcaagatcactttttttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaactagaacacaagaagccaactaatgaaaataaattcgaaaaaaaattacaagttacagagctgggatcctattttcccctttgaagaagcaacctattcagtataaacagaggcagcttatttaaaaagcactttggcaaaataatttagtttgtaacctttgacaaagtaatcataatcttaaggcatataccttaaaaaagattcaatgggtattttgcaccatggggtgtgttttcagaagtcctaacagcataatgcactatctaaatataattggttaagtaacaggacaacaccacatgcctcctaatataatgcagtgaggaggacaccatatcacttccaggagttctcaccaaaaactggcaacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaacaagactgatccacattaaaggagagtaaggagacatgtaagcaaaatgcaaagtgtaattctggatggaattctggagcagaaacaggaaattacagtaaaacaatttgctaaatttaattaagattataggttacataatagtttatcatttactttaatcattttcctgattttaataattatactgtagttattaacatgtggacaatctggcaaaatatatgaaaaactcttcatatttttccaacctctttctaaatctgaaattatttcaaaatgaaaagttaatacattttaaagaagtcccttttaattgtctttatttctgaaagataccctttttcataccctttatatgctttttttttttcaaatttccttatgtggctgatactacttttgtatttaacacagaaatggtacaaaaacaatgatacatttgtaaagaaaaatatgtggggtggagagaaagttctcatcttgtcttaaaacagtatttcaccaactggtcctaatattaaatttaattcgcacaaagataattagacatcgagtgtcattagcaaatagcaaatccccccagaatatcaaagcaaaacaatcaacctctattgagacatttatgaattgaaatttgcgaatacagctgggctaactttgacatgacctcaccaaatatgtgagtgggagaaagatcaagcctccataacccattcttctgttttagattgtactgtcatggctctcttccaaaacaacaaatgaagagagagacattaggacacagacatgcctgctttcatacaaagcatacacacaccagaagttaaaaggttgaggtagcaagtaactgaggcataagagccctcaaaagtgattctcagtaagtacagcaccctaattatagtctgaaacaaaaatcggccgggtgcagtgactcatgccggtaatcccagcactttgggaggccgaggcaggaggatgacctgaggtcaggagttcgagaccagcctgaccaacatggagaaatcccatctctactaaaaatacagaattagctgggcgtggtggcgcatgcctgtaatcccagctatccaggaagctgaggcgggagaatcacttgaacccgggaggcagaggttgcggtgagccaagatcatgccattgtactccagcctgggcaacaagagtcaaactccatctcaaacaacaaaaaaaccccactgttttcaataaaattaaagccacttattttgttattctgacaactcctcatccccccctacaaacccagtatcttgatagcagattaaatgtcatgtttcaatctacaataagatgatactacattaagagactacaaatattaatgcttactgtatgacctcatgtaaatagctgaacccctgagctgcagtgtcttgatctgttaaaataaaaaggctagatcagatgtccctttaaccctaaaattcaatgactcaatgaaatttctgtatacttaaacatatttctacaaatctataaattatgtaaaactcccagtttatattattcaatttaaaaactcacaaaaataccccacaaatgtcattttaataacatcctcattaatagatttaattccaactcttcagcatagtgtagttcaaatttctggtcttgtacaattctcttatgcagagataattttcctataatttttattctgtagagacactgggccttgtataaatcctagatctcttaaaattttaaaaagaaatcatgcaagaagcccataatctgtcacacattaggggcccatagatttaatctcttactcccccttgtggccggagtggcttccattctttgatttgcaatttcctcacttgctttcaaccaattagaaaagtgctccaccagaaatgctaatgattaggaggtgtcaagaactaatttattaagtcttttagacattttgactttaaattattacctttctatgcaatgtggcctaacagaataagattttaagctgtgaacatatgttctataaataaggtcatctataagcaggcttgtgcctaatcacttaacgcattttccattaatagatggcaaatctgcacttttaatcaacaagaaatctggcaaagcaagatgttcctgatgttcaagaactgttaaagccagcctaaaactttattaatataattcctgttaaaagagtagctgctccctgatatttaccccaaaacaaaagatacctacactaaacaatgctgatagaaagccccatctgttctgttctaaaactttttttttttaatcaactgggtgaaagggctagcaggaagtgagaataaaaactgccaaattaaatcaggttcagagaattgtctccctccgaatcatgaatgctagcaaaataatcctagaaggaatcagtgttttaagaacatctaacgctgggcacggtggctcacacctgtaatcaatcccactttggaggccgaggcgggtggatcatctgaggtcaggagttcaagaccagccttaccaacatggagaaaccccatctctactaaaatacaaaaatcagctgggcgtggtggtgcatgcctgtaatcccagctactcaggaggccgaggcaggagaatcgcttgaacccaggagacggaggatgtggtgagccaagatcacgccattgcactccagcctgggcaacaagagtgaaactccatctcaaaaaaaataaaaataaaaaaaggaacatctgaaaacaaattttgaaatgttgttcctaaagattaaaagtgaaatactaggccaggtgcagtggctcatgcctgtaatctcagcactttgggaggccgaggcaggcggatcacgaggttaggagatcgagaccaacctggctaacctggtgaaacctcatctctactaaaaaatacaaaagaattagccgggcgtggtggcggccacctgtagtcccagctactagggaggctgagacaggagaatggtgtgaacctggaaggcggagcttgcagtgagccgagatcgcgccactgcactccagcctgggggacagagcgagactccgcgccactgcactccagcctgggggacagagcgagactccgtctcaaaaaaaaaaaaaaaaagtgaaacactaacaagtatcaaaaagaacttatatcaaaaagaacttaatgagtagttaagtataaacttaaaaattattgacactcactgaaggcgttcctcttctcccctcccccaggatctaggcctgcgctgaagtttctcacaaaccaaggcccaatttaccagtatttccctcacgatgctttttgttgttggtggtggtggtagttaaaacgcctcatttttcatagggctttttagcttgtaagtggcacgctatgtattatggataaactacatgggggactatattttatcagcccctttttaaaaaaggctaaagaccagcttttctatgttcaatgaatttgcagtacttttccctctttgacttgtattatttgtgcacgtctatttccctctccagactgaagagcaggggcttttacatttatttttgtaatagcccagggcttataaaatagcaagttgtcaaatattaaataaaaaatttcagctttctaaagttctcttaaatttaatccaaaatttataaatgaaaccacaataaagtgatatcacagaggtacaaaaggtaaagcagtgtatttgctatttaacaccaccacaggggtgtgttaattcaacaatttcctcaaaacatcctagaggtagatagtattattcccattttgaagatgtggaaacagagtcacagacaaatgcagtaaaacttgccccaaatcacacaatgaatcaaaaattcaaaaagactgcatggctcatgctaagttttatcacctctcttaaagtaaggtagtatacactttagtatcctttatttttagaaatgttacacagggatatgcttaaagttttatctctgctccaattaaagaaaaagagcctgatgctagtcctccattagatggcaacaatcaaagggcaactgggaaggaaaagtcgttactcttacaaaaagcagattgcttgagttgtcttatttctaaacatcttcctaacacaatgctaaaggactcatcaaattgttgaattgagaacttgcctgttctaggcaagaactacagcttgcctatataatactaccttcaactgtcaattccacagaatcacattttaagtaggtattttgcataatattttcatcaagtgtctcttggttgaatgtggtccaagtatgtcattctaaactggacaatgtttattacgtttaaggagcaaaaaaattataagctgagtgttcataagtcttggatcaacaaataggtctgtctcagaaaagcgtttgtaattaatcacttagatgagaaacattccgcataccagtgggttccttggtataacgctaatttttaaaaactctagatcccaaaaattgtttgcaagttagaaattaactgccactaaaaaacatttctaggccgggtatggtggctcacgactgtaatcccagcactttgggaggccggggtgggtggatcacctgaggtcaggagttcaagaccagcccggccaacatggcgaaaccccgtctctactaaaaatacaaaaattagccaggcatggtggtgggcgcctgtagtcccagctacctgggaggctgaggagggagaatcgcttgaacccggaaggtggaggctgcagtgaggcgagattgtgccactgcactccagcctggacgacaaggtgagactgctatctcagaaaaaaacaaaacaaaaaacgacaaaaaaaaaaaaaaacatctctaacttcccaactcattaaacgattaaaataaaatactaatacaacaaaaattgggcagtccctgcaaatttaatgcaataatccttcttagattttaaaattcaacacatgcatacaggccaacccattaagcaaatcttatgttggtccgcttaactttatagattaatacttggctgaaactatccttatattcttttacctgttgttaccactgtaagcacatttttatttggggaaggaaggctcacaacaaatcctgtcaaaagaaatccacaagagcttacatgctgaaactttttaataacctatccaatgtaaacaaaagggcaggtgtcacacaaaatgatcttactgatatcaagtcagctatattcatccacatggctttggtgcctgaatggcaatagaaaaaaaaactagtgaaatctgccaatatgtaaaactctatcctacactacactactacttctatcacattataccttaccagaaaacaaaactaaatcaatgacaactgctattgcacagtaactttcacatatacaagcttttcataattaaatggaattactgactagagaacaagtgaatgatcggttacatagaaatacacataataaaaaagagagaactgctgatacgaccgttcttcccacaccaaaatttacatttgtgccatctaaatatcaaagcatatactccttcagtgtactttacaaatacacaaatgttttcaaggagaaaagaacagagccaatcttctgatgctgaaagacagataatcaagattaaaataagtcctaaatcgagtaatgaagcagaaaccctcaggccataaagatggtaattagcaacagtttgtatcagggatagtgagacgaccaaactaaagctaaaagcctcttgcagggaattctggcaaggatcaagcaaatagatggaatgaaatcagcattttagaaagattagaataagaaatacatgcaacatagaactgaaaaaggaaaaataagagtaacaagtccaagtgaatgaccacaagcagcagtaaaaagatgtttataatttagcttttgtccattaaaagcacatcaagtttatccatacagtatcattttcctatttggcaatgtgcacttttctgagtataatcctgggaactatacaattcagcgtgaatgtaaaggatagggaaccaatgatatgggaaacatcaacagcttgtaatctgaaaattaagtcaaagttgagtccaacatgtcgtgtgattaagtctagaaaacatgctaaaattgggtagttataaagaacaggcagtttcaaaaggaaaaggaatgctggctttgagtatattgaaactgacagcagttctaagtcccctaaaaccttgagcggtgtttattctctatgtggaactgtcaagagtaaagcaaaagctatgggaactagaatgaaatcacaatagggaaccaggaattctacaaaaaattctaagaaacttattagaatttcaataaactatatgctaacttttaaaacttacttgatatcagaacacctgtcattctgacttaaaaattctcacacacacattcaatataaatatgccaagagtaacttattttggaatcaaaaatttgagaaattaatccaaaagtccaatgacatttaattcagtattataaagacagagctagtttcccttcccatcaaacagcaaaggcctctacacctttccattccctttcctttattttcatcatttccacttcatatacctcagactttttgtatttgtacaaaatatgtcattgggtgtggcactttacattaaaaaaaactgaactttattaccaaagacactgtccaggccgggcgcggtggctcacgcctgtaatcccagcactttgggaggccgaggcaggtggatcacgaggtcaggagaccaagaccatcttggctaacacggtgaaaccccatctctactaaaaatacaatacaattagctgggtgtggtggcgggcacctgtagtcccagctactcgggaggctgaggcaggagaatggcgtgagcccggaaggcagagcttgcagtgagccgagatcgttccattgcactccagcctaggcgacagagcaagactccgtctcaaaaaaaaaaagaaaaaagaaaaaaagaaaaaaaagacactgtccaattttttccttcctgagaccacagaactgggattatttatactttgaaacataccaaaaccatgaagacatgtaaatatacagtatatcttaataaaatgaaatagtaacaatagatataaccctacagagttctttggagaagcccttattccaatgagctgtctagtgattttcatcttaaaaactgctaactctacatagcagtttttaaagcccaaggcacgtaataatatattcagactaaaacggacccaaagccgcttgctttcttatttctgtttaatggtagttctgtgggctggagataaaaatcagtgacccataaccacaacttaaaattgccctgagcaaataaaaacgtagagcagcaataaaatagaactcagtcaaattaacagaatcactattaagattactcaactgcagttgccaactgttataaatgttagacacacaattttacactgcttcctctcggagacctcctatataaagtcattctctgcctacagcagtggattttaaattttaaaatgaaacctttgaaaatttgatggttggcatggaccttctgccccacaaaaatacacaattttaaaggcttcttcaatcttcgaaattccattcatggactgtaagttaagagacccctgcactattataggcaggctcacacttttaaatagaactgaaaagctaagataaacaggacacagaaggtagtcaaggtgctttacctgactctcattccccacaaccctgtgggatgagtattattcctatttaattgagcttagttttctcagagggactgagtgatttcctcaggccatgcatctattaaatggtaaaactagtttgactcagtatcttgagctccattattcacctcgacatacttctttgagtttgaaagaggcttcctagactgtatttccttggtattcatttcatcatgtgcaagataaaaactacccaatttttggctgccatctttcaggtttaaagaggtactagtgttgagtccctccccaactaccaagagagcttttgtctaagcatctggcaggaaaggcagattgcattagttcacatattgcagtttgaaattaacacgtggaagagaagaaacccaagttcttttacataatgcaaagtccacattgtgaagagcatgccagtgaccacttcccgccataatgctctatttactcttgtaatatgcaacatggtccaagctctttgcttattaaatggttaaacaatagataaatacatataaccagaatgggttactaaagagctcttcagaaaaactcagaactttggagattagctgctttttgtaggaagaaagtttattttcatagctattataaaataggtgctcaatataaaaaatctggttatcactaatgccacaagccaatactattatttctgcaaagggacacctgcttatttttctcaaattaaaaaatatatatatcaaagcccagaaaaggctggagtaataaaaaattataattgattttttatcatgtaagatcttaaaaatataatttaaaatatttttactaatcattaataatgattcaataactttttctagtagaaatatcagttctgctacattttattcttccatctcacagaaagggcagaaggaattttatgcaatatgtttccagagtcgatgtgacctatttgaaaaagatggtaggaaaaagaagcctattatcggtaaatatcaaattttcccaagcagaaaaagaaaaagctagggaaattttgcagtgctgctgacctaattctatgctctttctctaaagaagcctttctgcttgtttaacaaatatttgagcatctattacacgttgagtatgcaaagatcactaagtcttactcctgaaaagaccaaggctggaagcaaaagcttgtttagaattctcttcaaagccatttgtatagtaaagaaattaaactctcatttatccaaactttcaaagtgtaaataccattaaaactttttgggaagccagtgctattctggagggtaacgatgtgggtagggaccagagtgaacttccttaataatcataacaagaagaaactatttatatgaagagattatcttgttatcctcatctactggttctatgcaaacaaagtttcttcataaggaaactaaagggaagcatagtcaaaactgctacaagttgggctggacgtggtggctcactcctgtaatcccagcactttgggaggccaaggcgagtggatcacctgaggtcaagagttagacgtgacctggtcaccagcctggccgacaaggtgaaaccccatctttactaaaagtacaaaaattagctgggcgtgctggtgcacgcccagtaatcccagctactcgggaggtcaaggcagaagaattgcttgaacacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagcaaaaaaaaaaaacaaaaaaaacaaaaaaacccaatacattttttattatagaaaaaaaaaatcacattttcaaaatttaaatatttggccgggcgcggtggctcaagcctgtaatcccagcactttgggaggctgaggagggcggatcacgaggtcaggagatcgagaccatcctggctaacatggtgaaaccccgtctctactaaaaatacaaaaaaattagccgggcgcagtggcaggcgcctgtagtctcagctattcgggaggctgaggcaggagaatggcgtgaacccgggaggcggagcttgcagtgagccgagatcgcgccactgcactccagcctgggcaacagagcaagactccgtctcaaaaaaaaaaaaaaacaaaaaacaaaatttaaatattcttattaccttagcaaaatcacaaaacagacatttgtcacttggccccaataaaagcaagatattccttttttcaacttagatacaaatagtagctatcattctaaaggtttcaataagcaaagaacaaaaaaatgccccaagacagatgcctcattgagtttgtggctgtgaacccaaataagcatgtttaaaaaatcactattctttaaaaagacagtgtcaagtaagtatcatttgagaaaattacagtttaggaactgatgctattccattagtaaatacaaatgtaaagaaatgatagtatcatcacaactttaacaaaaaccccaaacccacaaccacatcagacattatcctattgctcattatagcacttcttccataaacaaggttcatatagtaagtaacaaacctggatttccatactgagttccagattcagtaatctgtccagaaaaatcgagatgctgcccctctttgtatatcagagcccttccatactggttaagtgtaaccatttagtaaaaccactttaaatattattccaaaaactgccagcttggttggattctctactggtttatcctcaaatttaaactattcttgatcaaaaagccctactttatatgacagattaaaattaaccaaaatgtagtttaattcttttaagcgcagtgcttcaacacagtaagtactgaatacttaaaatactcgattcaaactggaaaatcaagcttgagttgttcataacctttcatcatggttgtgagtgttcaaaatttaccttcaagaattcaatgcaggaagaggtttcatagttgtgacgccagagttttctgcatggttgactcattacattaacattatagcggctaatcctgagaagagtactatttctacaatgagtatcctattacatctctcttacctaaagtatgtaaaattcctttatccacagatgtacatttaagataaccagctatagagctactacaaatattctaaccataagtaaaacagtaacacaattagtttatattttcaattaatataaaatacaatactaaagtctgttatttttaacaaaactgaactgtttcataatcattgttgcaattattttacatacacgtatctataattgtcttaacatctttttagtcatgacaccatgaagacttttaaatttggaacacacaatgtttagaaggaaaagaaaaaccaaacaaaaagttaagagtaatgtaactgatactcatagggaccctacagtataatgaagccagactgaattgattctcaccagtacatcattgcagatatctcttagctccgtctcaattttctctctgtattctcgagccatctgctgttttttctcagcaccttccgtcttttgttcaatacttgagacgaccctccaagatgacctacgggctcctacaacatttttataagcaactgagagaagattcctctcctcattggataattcagctccttgctcagttacagacttcatgcaggctgccatgtcatcatatcgctcagcctgctcggccagtttggccttctgaaccagctcatttttatccatgactggatgttctgcaggggggaaaaaaggagtatttaaaatttttcccatcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacatcagtgtagcaaaacttaaaatttgttcagaagacccaaatttcacatgtcaaaattacttccaaaagctgcctcaaaaactacccctaatcttacctgatcaaaatctcaactcatttccaataccactaagtgatccaaaattaagcagcttttcttcctttagtaaaagcattgtttacagagaacatctggatttctatcatatttccagaatcataattcatatcagtttaatgtaactcacgtctttttactttcataatactcttgtcaagagtgattacattttagctttagtgttacccctaccccaaacctactagatctctgcaacaactgccagccaataatagcataacaatttgggggggaatgaccaactgtttgttttcagatattttgagtataaatccaccacaaaggatcaatatctgaccctaatgtctcaactctttatcttgttatatgtccacatgctttaaaaatatccgcaagtcatgacacttcaactcttactgtgagtactagaatatatcacattggaagtacttaatttataagtgtttccaatgtcatcgctccagttgaaatgcagaagtgctgcattttgcttctagccatcataatgtaattggatgttaccactcaagctgtcctttaccatgactacccatctaattctctttccctcgcattttagtttcctggaccttttcgatttacctcagctacatttttctggaaagatacccttttgcaagttgccgaacagcacaaagatactaatccacacagtgacaccacagaataaatgacttcagaggaaaatacacaccctgaatgaagtgcacttttaagttagaaggtgaacagaagagtccaccttggcagctggctcccgaatattaatcatcttttaccttcccagggaaatcccacaatatttttttaaccaaatgagagaacaggtcgccacattttaaacaaataattaaccactttggatgcaaggtactggctcaatacgtaaactatttaacctttatgacggcattattttcgtcaggtctctaaattactgatttttcccttaggatctcagaaacgctctctggttatttctgcttctaacaaaaaatgatttaagccagtacaaaggattctctccccaatcacttcggtacaagaggaagtggataaggtttctcacacagtaacgagtgctccaaggcctcgcctctacactgcgggcaggactcaccgcacccatttaacccttacctgacttgagacgtcggttactgtgaaacgaaaacgggcagacccggactttaaagtgcaaattctccggtccgcgtatcgcaaccacccccctccaggctccgcccaagtcggagccacggctcaagtccccgactctcctcctttgtcatggcggatctgtgtcagggagcccaacctactgcagagtgttaattcctccccccgaccggagccagagggaggagcagcccgcgcccccgcccaagccgtgggggggggggagagatggggagcgaagccgcccgaccccggggcagagacgccacagcagcccgcagaagcggaaccactaccagccccgccgcggacacaccccgctctcccacccagcgccttccccgccaccgatcagcgccggtgaccgtgtacagcgtctctaagggaccgacagctgcaggtgggggaggggacgagagccacacccagccgagcgggccaccagcggctatgctcaggctcacccgcccccaaagcaggatatgcgtccccaaaccgagcgcagggaccctccagttctagtccatcaagcacgggagccgactgcgggctcaccaccctgttctctaccccgacctggacttgcagcccccgtccacacctcccccgcccgttcacaaggagcaaaaaaagtcagacccatcccccacccccaccaggaaaattcaagtccttcctcccaccgcggagcccaggaaattcagctctaggtcccaggcgagccccaccccaaaacctcaccccgcagtggactcccctcccgccggcgcgcagcctcgccccggtctacctggcgggcgccgccgcgccaggcctgggctccggcccgctctcggccaggcctttccctcgcgcttgggtccccgaggcccccggcccctccccgccgcgccaccgcctcccggggtgggggagggccgggtcccgccgccgcagcgcccagcgcggaggctgcgcgagggggagggaaaggagggggcggccgagggagaggggagggggcggcctcacctgcgccactgcgatgcccgccgccgccgccgccgagtcattatctcgggcggaagcgagaagggcggcgagggagggggtggaagcccgcagagacaagggtggggatggatcgcggccggcggcgccccggccatgcctcgtccaccttcgggagccggcgacagggagatccccagggatctcgcgtgtgggcgccctacccacccccgggggcaggacgggggagcgagcaccgatcggcgccggggcgtcgatgcggaagcaaggagccggaggcggccgctagccgccctcccgagcccagcggaagaggagccgccgcccgtgtccgctgaggagactccgcctcagcccggcgccgccaccgcggggcgagtggggatgaggggacggagcgaggacggctcccacgcgttcggaaggctggcctgggacaggaagcgaggcgcggcggcggccgggttcctcacctgtgtccggagtgggtggtggcggcggacggacgggctcagcagtctctgggcggcggcggcggcagcagcggcgaggctgagactctgtccctggatctcgctgctcacaggctacagccgctccgcagacacggggtttcctccaatcaccagccccggcagcaggggcaccacacgcacgatgacgtcaaacgctgc

SEQ ID NO: 2174 - DNA, 26293 bp, Homo sapiens
aataggttagtttcagacaagcctgcttgccggagctcagcagacaccaggccttccgggcaggcctggcccaccgtgggcctcagagctgctgctggggcattcaggtaagcggctgtcctcgggccttctgcctgtgtcctgccaccagggccaccccagggggctctgggagacctggcagaggatgaaccccccccatccatgagtgagaaaccctggcggggtgtgacatcctcccccggggtgtgtgcggagagtgtgagcggcagggcctccctctcaggctgggggcttgggctgcagggaaatccaaaccggctttgtaagccccgattcctcacccagaaccggctctccattggcattgggaccagagaccccgcaagtggcctgtttgcctggacatccacctgtacgtccccaggtaagtggtgcctgggtggagtggcacctggccaccgtctccatggtgggctgtgtctggaggaggaagacagaatattaactgggagtcaggaggttgctgggaggaccaggagagctggaggactgggctgggtggtgactggctggagatggaggcagacggggcttgtggccacgctgagggaagcagctccccctccagaggcttggccgagcggggctgttcaggggacacggtgaggcctgctcagtccctgggctcctgctgggccctgtttggctgcatccttggctctcggaggcagagaaacctccagagaaagcgcatgtgcactctgtgaagatgagggggctgctcaccagggccgtgagctccatcagcagaatgctgtgattcctgtgaggagtccagggcaggcttgagccacttgtaggcgagctcaggttagaggaagacctggagagagaaagagcaaaacaccgagttctcctcaactgctgtgtgttctcggcaagttgcttggcctctctgacctcagtttgtgcatctgttaaatgcacatgcagatatgggcacctggcaggcgcctggttcctgactgttggcgagaggctgggaaatgtgtcccaggtaggaagcatccccgacaggaaggaacaggagttcatgaggtgagcagctcgagatgattcattactctcgtcttggttggaacagtaggcagacaggaggtgtttaataatgccttgctgagagatcagggtcagggactcctaaggtgccacctgtgaagctgcctcctgctgaatccagagcttccttttcctcttcacacctgccctccatcctcagccccactgccctggcagtgttgcgggggtggtgttgatgtgcacactctggagcctgggggcctggcttcacattctggctctgccactcaccagctgtgtgactggaccagtcaccgcatctctctgtgcttccctcccagggctctcgggaggataaagagagtgactgtatccacactgcccggcacatacaggtgctgcagaaaggtctcactaaaaccctcattatcctcactagctctgggtggcctcgggctctggactccacagttcctgtatgctctccggggctgcagcacccagaccaccccgtgctgaccactccctgccccaccccaaggtacagggttaaggcagccattctcatcagagccaattttacctcctcccgtctccctgggacagttgatagtgcctggagacagtttgggttgtgacccagcgggtgttactggcatccagcatgtccaggacaggaatcctgtgaacagcctacaaggcccaggacagtcccaccctgttccattgtctctatcagcccctatcctcctgactcacaccgccttttcccatctcccttttacagtcacagagcctgaggcccagagagggaccgctgcttgctgaggtcacacaggcagtggaggccggagttgggggcctcactggaggggcggtggaagggcattgttcaatcaacagacacttggagagtgtgctgggttggggaatctgaccctgaccccgcaccagcccagctctccagggtctcctaatagacatttgctggagtggttagtgctggctgctgcattggacagacctgagttcaaatcctggtggccccttgcaggctgcatgttctgagagtgacattgacctctccgagcctcagtttctttagctgaggagtgggataacagttcccaccaaatgtagttgtggtgagaattagaataaatggctaatgctcgcaaagggtagtgcagtccccagcacagaggctgttgtgattgtccttacacacttgacaaatatttgtggggaggaagcaggagcttccatagaaaacaagacagagccgtgggccctgcctcggggagctcagcctggtgagggactgaggagcagagacagaggccatcagggctgtgatgtgggaggatggggaccctggaagcctaggggaggtgcctgacccaggctggggagggggcagggctcatggaatgcttctgggaggatgggacaacggaggaggcctgaagccggaggcccagtagaaggatgcagcgcagttctgggctgagggaatagcctgtggccaggatcctcaggatgggcccctcctctcccgccatcctccacccaaggaagcccctgtggcccctcaccccttcccaggtgtcaggttccaccggtgctcagaggcatccccacccatcccagtggactgcagacctttgtaggtacctggtatattgagcacctcctctgtgccatgctggtataggtaggagaacaagacaaaggctccactcccgtggtgcttacattctggcagggacaaaggtactatgtcaccaatagatacaatatcatcttttaggtggtgaagaacaacaaagctgggtcagggctagagagagaaggagaggctattttggagagggaggtcagggaaggcctcctggaggaggtgacttaggcagagacctgaataaagtggaaggtgttggaggaagagtctccaggcagagggaacagacagtacaaaggccctgaggctgcaccatgcctggtttgtccgagggacctgaacgaataacatgaggaggcccgtgtggctggaggggagtgagtggcggggggtggtgatgggcatcatgaagggccttgggggccaccctgaggacttgcattttcaccccgagtgaggtgggagcctagagggcttcaagcagagaagaggatgtgatggcatgacgggggccagcaagtctcaccccagggagtccctgcagccccagtgctggacaccttcactggccctgctttccggaggaggtctggcgagcttcactcgctgctgaggctgcactgtgaccatgtggtgggtccacgattccatgatttgaatccaatccctgcagtcaggaaagacatatgaaggaggagcctgcagccatggctaactgcggctgtgtggctcatggcgtcaccaagctggcgtgtgctgacgaccagtgcctatgctgcctctgttggtgggcacaggcggcccgagcacagctgggggattaaggagcagggaacatggcttcagagggacttagggtctcaggtgaggactaggggttcagagagagagagccaggagctggagtgggaacagggtggtgggggggcagtaggaggaggtggggcggtgaggggctggggccctgctcctgcagagccttggatggggacatgtcaagcctctggctggggggacatgcggagcctctggctggggagacatgcggagcctctggctggggggacatgcggagcctctgagcctctggctggggtgacatgtggagcctctggctggggggacacgaggagcctctgagcctctggctggggggacacgtggagcctctggctggggggacatgtggagcttgtgctgctcctgcccgctcccaccaggtccagtggctttggtgtgatacctctgctctgacgatgggcatgtaatgggggcttctgatgcccagggaatgttctgtgaaacagtagaccttcaaggctttgctgaataggtgtgggaattaagtgacgctgaaagaggtccttccatgtggtcttctcggagcctttaatgtgcttttcacagcatttgaaactgtatttgaccccttgactcttttttcctttgaagcatgtttggggaatctgatctctctggaacagctgtaatctagcactgcctttacccagggaggctgggtgaatggtgggattccaggcaggtccttctgaccaggctccaaggcttcctcccatcatcctcccagggcctgggctgtgagtgtggggcaggtgccccgtggctgctctgctgtgatctctgtgctgtgatccaggggctgtaagttctgggaaggccaaactaggatctctgaactgtgagctcaagaggaagctgactggggtcagcctagggagaaccataggccaggcttggggaatgaacaggctcactggggactgagggacgcggctcctaacccaagtcctgtccgtcgggatggcccaggcaggtcgagggctggggtgggtctcatggtgggtgtgtcttctgggagggccacgagtctgcagggacacagctgagaacagaaacatttgatcccctgcctggggtctggggtcaccccggggagctctagatcggtgcagctcactgacagcagacactccggctagccgctgcgtggcaaatgctcccacctcttgcccccggacttttcatctctgccacctctgcccaccttctctggcctccccagcatctctggccatggggtccctgggaacttgggccccatgttttactagtgaggacagtccagaaaggccccaggggtggaagaggaggcgcccaccacccgacctgtgtgtgtggggtggtgcttgtgattaccgttgtccttgtgggcagtgggacagggaagctgggacgcagccgagatgcacaggaagagagcctgcctctgggactccttagcctcgggtcatggatggcagccctgggctgggcactgagcctccctcatctcctcttctgccctaacccacttctagctacccaggctgcacctgcggccacgtggggaggagcttctcaaactgtgttggcgacagtttcctgccacagcttcctgccccagagaccagctttgctactctgcacccatggtccttggacaagccctcagttttctgcctcatcctgcatcctcatgctttatgggagtggctccatgagtcttcaaggatgggctggctgggttggagaagatggaggggagagggaagggtgcactaggtggagggtgctgtgtggatgaaagtatgaacatccatttgaaggaaggcaagtagcacagctcagctggggcagagggctggggagatccaatgcagtagccattagggtcttgagcaagggaggccttggggaagaattgccaaggagcaacttgcagactctggggctcagctctgtggaaatagactgtgaggttcagccagccacaggcagcatgagcatgccatctggatcttaggttggttgtattaatggaaacagttggtggagatcaaaggagatgatgccagcaccaaccgacctcagtcgggcgagagatctgggctctgggagaggtgggtgtggcagcatgtacagctactgacaggatgacccaagtaaggggacgggggtgggggaaggagagtgagcaggatggtcagagggcagaggcaagccagggagtttgtgaaggaccagagaggtctgtggggctcaagcaggagggaggagtcataggtgtcggccattcagggggcccaggattgaggaggtcacagagtgcttgtctggtgcctacagactgccaggggtgctatcagtgctggagaacagcctggggggggggcgcagaccaggtctggctgagaggctgggagtcaaggacatagggacaggagtgtagacagcccttaatcacttttcctattttcattagcatttttagtgtccattgtgtctgtatcttccagttcctttcccccttaattaaaaatttggggtataatttacatgcaataaaatttttatatcattttagtgaaaaattctgagatttgacaaatgcatacagcccagagactaccaccacatcaatcaagatacagactattcccccaaattccgtcctgccctctgtcgtcactccttctccggcccccagcacccagcaacctctggtgcgttttccgtccctatagttgtgtgtggaatcacacaattcgtagcccttggaacctggtttctttcatccagcctgaggcctttgcgatgcgtttgcggaactgcgtgtctccgtatgctgttccacttaccgcggagtagaattccactgtaggcatgtcccacagtgtatcttattcatctgttgggaaacatgtaagttattcctaatttttggcaactgtggctagtacggctataaatgttcctgtgtaggtttttgtgtgaatgtaaatttccatttctttagagtgaatacctaggagccttcatgggtttttttgttttgttttgttttgttttgttttgagatggagttttgctctgttgcccaggctggagtgaagtggtgcgatctcggctcactgcaacttccacctcctgggttcaagcgattctcctgcctcagcctcctgaggagctgggactacaggcgcccaccaccacgcccgactaatttttttgtatttttaatagagacggggtttcaccatgttcgccaggctagtctcaaactcctgactttaggtgatccgcctgcctcggcctcccaaagtgtgggccaccgggcccagccattaatttttgtatcttaatggagacggggtttcaccatgttggccaggctggtctcagactgctggccccatgtgatccacccgccttgatctcccaaagtgctgggattacaagcgtgagccacttcgcccagccgcttcatgactttttaaaaacactcttgtggaatggtgacctttttctccaggtggagccacaaatgcagtcccttatgaatctctggaacacccacctgtctgtaactgttgggacatccaggacccccctcaagcttggccctcccaacctcactgtcacaatcaatcgggttacagtgcagatcctggcccctcctctagctactctgacccagacttcacctgattcccattccagtaccttcctttcagctccagagcccatctctggacacccagggcagagggagctttcacaaaagcattcattttaccccttggttgcatttgcataactaagaagggcactcaaagtcaattctccaatgcaaacttatgcctgagtagccttgctgggcctatgttagtagagaaacaactcagaaccgctatggagaggtattttttcccaacattctatgaaaacttacaaatatgcagaaaatagaaagaattaactgtacaccaataactcacctgctagattctccagtttatgatttgctataattgctttatcacatacagttgatcaacactgcggagttcttatttgtgagtttgcctacttgttaaatttatctgaaaccctaaaaccaacatggcacttttgtggtcattctcagacatacagagtggcaaaaatatgaatcactcgatacacattttcccaccgaggctgcacaaggcaaacactctcatgctgcagataagtgtctttttcatgttctttttttttgagacagagtctcactctgtcgcccaggctggagtgcaatggcgtgacctcagctcactgcaagctctgcctcctgggttcatgtcattcttctgccttggcctcccgagtagctgggactacaggcgcccgccaccatggctggctgatttttttttttttttttttttttttgtatttttagtagagacagggtttcactgtgttagccaggatggtcttggtctcctgaccttgtgatccacccgcctcggcctcccataatgctggattagaggcgtgagccaccgcagccggccaatctttttcatgttctatttggtggtgccacatattttgtttttttattttatcttttttttttttgagattgctgtctcgcactgtcgccccagctggagtgcagtggcagtggcgcgatctcagctcactgcaacctccgcctcccaggttcaagcaattctgcttcagcctcccgagtagctggaattacaggcacctgccaccatgcccggctaattttttgtatttttagtagagacggggtttcactgtgttggccaagatggtctcgaatgcctgaccttgtgatccacctgccttggcctcccaaagtgctgggattacaggcgtgagccaccacgctcggcctattttatctttttaaagacagagtttcgcgcttgttgcccaggctggagtgcagtggcctgatctcggctcaatggaatctccgcctcttgggttcacgaggttctcctgcctcagcctcccaagtagctgggattacaggtgcccgccaccacctctggctaattttttgtatttatggtggagacggggtttcaccatgttagccaggctggtctcgaactgctggtctcaagtgatccacccgccttggcctcccaaagtgctggatgacaggcatgagccgttgcactcggcctcacatattttgaatgtttgtgctttttgttggtgatttcagtggttgacatggcccccaaccatagtgctgaaatgctatctagcattcctaagggcaagaatgctgtatgtgccttatggagaaaacatgtcagataagcttatagttatagtgctgttggctaagagttcaatgttagtgaatcaaccatgtctattaaataaggtgcctttaaacagaaactcacaaaaaaacaaggttatgtcttgatcagttgatgaaaatgtaaacagtttcctaggaacctaactctgtatttcccctaggagggatagttctatattgctaattcagtgttttcgttgactttatagaactgcagagaatgacagaaatcaactgtgtctatctggctgtctatccttttatccatccctctcgctctgttcgtccatcggtcagtgttatttttgggatgctctcaaattagattacagtcctcagttcccatcactcctaaacatttctgcaagcagatcgttacctagggttcaatattttatgtttcttttttaattgagggagggcaaatacaatggaatgaacacatcttaagtgtacattctcttagttttcggaaaatcagacacttgcataacccaagccctgtgaatatacaggacgtcaccatcaccccagaaagttgagggcaggcaattttaagttatctgccttaccagatatccatctgtctaaatagccttaattcctcctcccctcaatcacacgttttgtttaatagctgtatcagagttcactttgagattaaaccctaatgcatttaaccagtcccctagggatggatattccaattagcgtatgctctgtagaaacttgccaaggaaggcagagggcagggcgaggggtgcctgctaaggccgaggggaaagggtcagcggaagggacaagggaggctgaggggtagggcccttgggtgagcaaagctgggtgcggcctcagggcctctgcgcatgcagtcctctctgcctgatgcgctgtcccgcgcgctttttgaaaagttggctcctcctccttcagctctcccttcaaatgctagctccttggagaaggtgaccatcctagctagagccacctcttctctctcttaatgtcactccacttatttcctttgtaatgctgacctcaatctgtaattattatttttgtttctttctcagtttatctcacggctctccctccttagagtgttgccttcgggaggacggggtgggaccgcgcctgcctcaagcgtgcatatccccagcaccgggcctgaaacacaataattcagcacgtggttgggacatgaagagatgggtacaggtgtgggtgcttggggaccagttggcgtgcttgggcgtccacataatgtctctggaaagtcagatgggggtttgggacttctcgatctgtgcccagcaggctgcggcttctctccaggttgactctggcacagagcaggctctgcccccttggcgagctcagtctgcggcactgatgccctccacttggcgtctctcgcgccgtctttgggcccaacgcaccaggttcaggaaggccctgacgtgcctccgaccctctgtgaacccgcaggtttcgggaggcccaggggcgatgccagaccccgcggcgcacctgcccttcttctacggcagcatctcgcgtgccgaggccgaggagcacctgaagctggcgggcatggcggacgggctcttcctgctgcgccagtgcctgcgctcgctgggcggctatgtgctgtcgctcgtgcacgatgtgcgcttccaccactttcccatcgagcgccagctcaacggcacctacgccattgccggcggcaaagcgcactgtggaccggcagagctctgcgagttctactcgcgcgaccccgacgggctgccctgcaacctgcgcaagccgtgcaaccggccgtcgggcctcgagccgcagccgggggtcttcgactgcctgcgagacgccatggtgcgtgactacgtgcgccagacgtggaagctggaggtgagagcgcagcctggggcgcggggtctggaggggcgtggccgaagaggggcagtcgagggttttggggggataggagggaggaaaaggtcgtcttccccattcagtcccctttggaagctggagaggtggggcactggttggggaagaacctgaaaggaggcctcagaggcaggggctccgtggtggcggtcgccttccgcaggctgagcgatgctatggtgctctactatgccagatgggaaggtagagggacgcactgggccgggcgaaggcgaggcttggaatgggggcggggctgagaggagggtgcgcggggctagggtgagcccttagggtagggtggctgttggggaagatgggcagtagtcgtccacagcctgagtgacaccaccatgcacaactacctgaattaggtcttcaagctggagatgcgcttggggccgcgctggaaggtgggggtggttcctccctagctggattggggaggggaccacggagatggcgcggaggtagtcctcgaaaacctgcctaacacgcgctagggacgcctgggtggggtggggagtcctctgggacagggctcccggaagggggttcctgtggcgagcacttggccacacctacagacctcctcgcctctccttttctagggcgaggccctggagcaggccatcatcagccaggccccgcaggtggagaagctcattgctacgacggcccacgagcggatgccctggtaccacagcagcctgacgcgtgaggaggccgagcgcaaactttactctggggcgcagaccgacggcaagttcctgtatgtggggcccgggatttgggtgcggtgaggattggggctcgttggcagggatcctggggactggggcagacgtgagtgtgcagttgggccgtaagggtgtccctgtgctcacatgtgcaagtgggttgtgtgtttctgatgtgcaaagggacttgcacatggggaagtagaggtagtgactaggaaagcctccagactcggtcccttggcctggcttggaatcccgcttccgccacctgctggctgtggcccttgggcaagtagcggactgtggttgcctgcctcagtttcccctccttcaatcaacaaatatttactgaatacctactgtgtaccaggcactgagcacacggcagtgagccaaaaagacacagtgcctgtcctcatggggcaggtagacaagaaaaggaatcaataaaatagagaccctgtcagatggtggtaagcgccgtgtgtgcaggtggggaggcggttgcaattttagattaggtggtcagaagaggccttcctgagaaggtgacttctgaggaagggaaagaagctgaggagtgagctgtgcagctttcagggggaagggtgttcctggaaaatgcaatggcaagtgcaaagatcaggaggcaggagtctatttggcgtgttccagaaacattgtggaggccatgtgcctggagctgagtaagtgagggggagaatgggaggaggtgagggcagggcggggactttagcttttcccccaagtgaggtgggatccccgggagagtgttgaagcagccccctctaactgtcctgtggttgacagcagtacctcccctcaggatcctctatgaggattacatgaattaatacgtgtgaatcgagagtatggtaactgacataggaaaaatgcggtaaatgttagcttttatatgtgggtgaacgtgcgtgtctgagccacagctgaggccatgtagctatttgtgagtttgttaatgtgaaaaaaatctctgaaaatctctttttaaaactctgctgagtgtttgacagccctgctggggctgttgctctctggtttggacacgggatcttttctgtaacagatggtatccaggtgcagctgaggtcactcaggcctcaagacacagataaattggtgctgcctctttcccatgacctcaggaagcccagtgttttcccccaagaaatctgtggggacaattcttgggccttccttctcgtgagtgcttcttggcctgagcccctgcccagcagatcccttgggtcatctgcctcccccagggctgtttcctctcctgaggtcaacccacttggaggaaatgaccacatcccttgattttcctcacccatgtgaagtttctgtagattgcctgcaggcctcttgcaagatgcagctccctctccaagattctgttgtgggctgataaaataactcttttcaccctaccatacagattcagatttaggctgtaaattggagtggagtttccaaggcttctgagggagctcttagatacatgttgcacgtaatactcagttgccggcacaacttctgaacaggacagggctgttttctctaagaggaaacctttgcatttgtatcagttagcttttgctacataacaagcagccctaagatttattggctcaaaatgacagtttattgctcttcatgattctgtgagctaactaagcagttctggtttgggtcatctaggctgggcctgaataggctgggatggccacactcacatgactggccattggctcagtgtcacctgggtgatggggatgagctggcccagtgcagccatcatccagcaagctagctgaagcttgtttgtgtggtggtggtgcagggttcccaagatcagtcagagaggacagggcaagttcaagcctttgtttgtgtaatgtcactgatgtcctaatggacaaagcaagtcatacgaccaaaaccaaagtcactgtagggaagggattccttaagggagaggaatgcagggagccatttttgcaaacggttggtcgtaggattggatgaagcaagttgtcgtgaaggtatgggcattgtgaacatgggtgttgggggctgtctctctttccttttggactgtcagcctgagggcagggcctgccctgctgcatctggagggctccatcttgcagtacatggtgatggctggtccaggtattacccaccttcctccagatgttgcatcaccccaccccaggtgtgaccctcgccaagatgttagtaatgtttgctcccacgttctcacatgctcatatccccctcgtccattacatgctaccccaggtgcctgagagtccaggggctctccccaggctggacacgcgaagaaggctctaaacccttcctattgatgtagctgattctttccttccgtctctgctttctctttcataaaatgtaaattcatctgtcttctttgattttataatctgagtttcttctctgttttccccctacatccccaatgtagcttttcatccccaccatctctgcctctcttctgtctcagttttcctttcttcttctctctttccctccccacccccatctctcttcctcatcttgcactcacacacacacatacaggtcatgattctgccactccaatggcttaaaaatttcccccagattccctaaagcctcctgagagtggcagaggattctagggggtgggagagtgagagaagggttgagcaggtgggatttgggcccctgttccagcttgaatgacgacagccgctcagctttgatctgtttgctatcttaggcttccacacacaatgttgtgtggcagaggtttcactgcccaaaggaaaagttcaaacagtttttgtgtaacacagcagagctcatgacaggcttagagtcaaccagtctgctgagattagaggagtctcaggagagccagggccaacagctttaagcagctgtctgtgcattgcatatcaaactggcgtgcagtctcccaggcaaataggacaagcgttggcggtgggagggtgtggctaggaaggagagatgcccagcatctgggcacagcatagagcgtgtggctggcagtgaggtccacagctggcacagtggtatgaggacaatgactcattctgggtaaacgtcaagagacgaagcagctacaaagagccaggctcctggaaaattaggcaaggtacgctttggacagaaactgtgagagcttcttcttgtggttcctgtagtctataactgctttctcagggcttggggtgtgagagaaagacacgtgctactcaggcctagagtgaagaccaggaccacgcctaccattgatcacagttcatggttgccgaagaacagatttaattgtacccagggctgtgcactgccaatgctggcttgtttctgtgttattggcagcaattttatggaaccggctgattcgactttaaaagaaacttgtcctggaaagggcctttaagagagtacattgtcaagtgtttctttttttgagacagagtcttgctctgtcacccaggctggagcacagtggtgcaatcttcgctcactgcaacctctgcctcccgggtttagtgattcttctgcctcagcctccctgagtagctgggactataggcgtgcaccaccacgcttggctaatttttgtattttcagtagagacagggttttgccatgttggccaggctggtctcgaactcctgacctcaggtgatccacccgccttggcctcccaaattgctgggatcacaggcgtgagccaccgcgcctggcctgtcaagtgtttcttatcctctcctggactgcagacctctttggaatcctactgactgctcctttcacaatcccccaaagcatattcacctcaaagactttgcagacagttatatgagatcatggttggtcctgaacctcgtccttagaacccttttcaggtcaagaagttatgatttagaccagttacctcattttatacataaggaaaccgaggcacagcgaggataagcagtttattcagggtttcacagataatctgtgacagagctgggtgttagtcctaggtagcaattaactgtagagtcagaaatgcatttgaatcctggctccccctcctatctcttaccaactctgcaatttaggcaagatacataatcttgtgcctcagtttcctcatctgcaaaatggagataacaatagtgcctactttgtggggagtgctgtgattataggacaaatatgtgaggaatttagaaccaatatcttaataaataaattgtagcccttttgttttgttttgtttacaatcgtgaaccagagacagatgtagctcttataggttctatgtattattttaagagcagagatacaagttgattttttagcctgtacttctggcttaagtgcaagttccaactgcaagaacaaagaactgccactacctagcatttttttttttttttgtaaatcaagtagaacttatggtactgaaatatatgtggtgataacaccaatgtcttagcttttgtggttattatctgggaatttgcagctgctctttatgaactcacacatctctttccaaagagtgtattggttagcttttgctgtgtaacaatgtgctgtattcataccctgaaatgtagtggcttaaaacaatggtcatttacagccaagtgtgatggctcacacctgtaatcccagcactttgggaagctgaggcaggcggatcgtctaatgtcgggagtttgagaccagcctggccaacatggtgaaaccctgtctctactaaaaatacaaaaattagctgggcatgatggtgggtgcctgtaatcccagctacttgggaggctgaggcaagagaatcacttgaacccaggaggtggaggttgcagtgagccaaggttgcaccattgtactccagcctgggcaacaagagcaaaactctgtcccaaacaaacaaacaaacaccgatcatttattcactcttgttttgcttggcaatttggctggttgcttggtaatttgggctgagttcagctgggtgcctcttctgctgggtttttgagcttactcatgtggccacagccagctggaagattggctggagctggatggtctctgggatggcctcactcacatgaatggctattggccactcatgtagggtgccttggttctcctccatgggccttctctagcaggctagcttggactcattcccatggtatttggagagctgccaggaaaagcaagagagggcaggccaacctcaatgttcaaccatttttcaagcctctgcttgtgtcatgtttgctaatgtcctgttagcaaggcacatggtcaagccctgattcagaagacagaggaggaggccccacctattgatgggaagagctccctaatattgtggctgttttcccccagtattccacatggaagtttaaataaacaaataaggaggaaattattagttctagaagaaagaatgaaagagacagacagacttggtggctcacgcctgtaatcccagcactttgggaggccgaggcaggtggatcacgaggtcagaagattgagaccatcctatctaacacagtgaaaccccatctctactaaaaatacaaaaaattagctgggcgtggtggtgtgcacctgcagtcccagctacttgggaggctgaggcaggagaatggcatggacccaggaggcagagcttgcagtgagccgagatcacgccactgcactccagcccgggctgtggagcgagactcggtctcaaaaaaaaaaaaaaaaaaaaagagacagaggaggggagatgggaggtttgctgtttgctggtgagtggcttggcatggagtctctgttgtcagtttaaaacttcaggttgtgacccttaggaggtgttttcacttctcacagtccctggagaccatcacctccaggccagcctgccacctgcctctgacttccacagctctgagacccccagggccaatagccctccctcctcactggaaagctgcacttaacaggagcttgtgccagtgactcaaaatagaaatgttttgtgggagatgttgactggtgtcactgcggggtttcacgtgacggcgctgcatctgctgtcccagcctactgtctctgtgggatgtttgtttcctaatttgtggtgggttctcttccttgcccttttgtgtgccctcattgcccccgccctgatttcccatctctccatgttatctccagactgttgtgggctagcctgggaactgccccacccttcactgcactgtacttcggggaacgtgctgtccaggaatggagaggatggtcacagctgcacctctctccctcactcaggggacatttcctaaggaagggccttattgcaaggtgggcccatggctgccttgctcactgccatatccctgcgctgagaacagtgcctggcctgtcagtaaagacttgtccagtgaatgaacatccacaggcagggccaggcctggtctgagaatttgcaccttggagggtgcagctcgcaggccatcacaagggctcttctgtagtgcagtgcaatccctgagatcaggagtcggctgcttccggcctccacagcttccacggggccagctgccctccctcctcactgtaaagctacacttgaccctgcaatagaggcttgtgccagtgaccccagacaaaactgttgtgtgggggatgctgactggtgtcactgtggggcttcatgcgagggtgccggtgtctgacactaagttggtctgtgttgaggggggatgtgtgtactcagggctggagcggatggggggacagtttcttaccccacaaatgcaccacctttgaggggctcaattcccatcatagacatggaagatttatatatttatattgacaaaattccagcagaaggcaatcgagggtctcattctaggaaaggtccatctattatggaactggtcagtctcgtgatgagaaagtgacttgttttgatttgcacaggggtgccctgtaagcttgtcatggagctgcgcctacctgtgtgggtctgtgtggaaaaggctttctctccccaggagaatggtgctaggtctacctgttgaaggctctgggtctgttgtagaaggccaagtgccccccatggttggctgactgtatggccgagtgtacccccaatgagtgcctgtggatgactatctctctgtggatggcaagtgtctggccgtggatggccaactgttcagccatgggggaccaggtgttccccagtggatgggtgtcccctcctccgtggctgggtgtccaccgtggggggtcaggtattccccgtgaatggccatctgttggctcttggagaacagtgcattttcctgggaacacagccatggcccctccaccgccctctgccacttggcccatcatcagcagatctggaggtgatgggggcctggcctggcttccccagtccctgcagcttctctgcaaggctctgaggtgtggagcccatagggtgtgttgcgggggaaccggggcacagcaggaggcccccaggtggctctaggggttacatcccctcccttcccctgccaggctgaggccgcggaaggagcagggcacatacgccctgtccctcatctatgggaagacggtgtaccactacctcatcagccaagacaaggcgggcaagtactgcattcccgagggcaccaagtttgacacgctctggcaggtaggctgcccgtgcaacttgttctgggagatgccgtgctcagatggggtgccgggctctggggaggagaggagcctctctgctagctgcctgctccctgcagctggtggagtatctgaagctgaaggcggacgggctcatctactgcctgaaggaggcctgccccaacagcagtgccagcaacgcctcaggtgacggcagcaggcgggcgggcggtgggcgggggcggcaggagacctggcccccagccctcactgtcccttctgctcccccaggggctgctgctcccacactcccagcccacccatccacgttgactcatgtgagttgggggcacctggagtgtggccttggggatggagctggggagtggctgtgggggaggctgggatggaggctggggtgcctgtggagcggaagaagctctctctccactgtctctgggagtcctcagtggatataggtctcatgagaggggctggacgtccccagctcaggccttgctgaccctgtggcctttagcctcagagacgaatcgacaccctcaactcagatggatacacccctgagccaggtgagcgggcagaggtggggacgcgggttggggctcatgctgagccgagatcagggtcgctgtcagggctgtggggtttcacggggggcgctgtgggccgggccaggctgtggcagttggcttggttaacacctgtgcacacatgtgcccacacccatcacacctgcctgtgcacatgtacgtcccagtgtgtactgacgtgcagggagcacacttggccttgcctgaggctccccagacacacgtttgttgagtacctactatgtgtcagtcacgttccgaggtcactgtgtgtatgagccaccgaaccctcctgacatgccttatgaagtggctatggtgattaacctcactttacagatgagagagggaggggtctgtctatggggatgtgaggcagtggtagaggcgggatgtgaacccacgatgggccccagagctcacattcctaaaatggtctgctgcgggtgctcctgtttctcatgggtgggcccagacctgaacatgtgtatgcacagagaagacacatagttacatgtgcacctagaggctcgcttttggaggcctcgtaaatgtggctgtgtgctgcatacgcagacagggacgggcccggccataggcgtacacgtacgaatgcacacacatgcacaccccagctggcacagtaacggtgccacgtggataccaatgcacacgcccctagagtccaccctcatgtggcttcatggggcacccacagctgtggccaggagtgtatgccagtgtgtgcgtgtggatgtgcaggaacacgcatgggcacccacctgcttgtgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagtatggccgcccctgccgtggtgggagcaccgccgcctggggcagaggggagtggcttcaccgggctgtgggacgggagccgggatgtctgtctcacagcagtttgcctgggaaacagactctggggcaggacgttgcacgctggaggattccctgagagagctcgggacacctgacgggggtgggatggggcctgggcagggggaggctgtggagctgaagttcccaacccaggggagctgcagtggggtccccgatccctgagtccactggcccctgacaggctgcccctggggagggtgtcactttggattctttttggcgatgggctgttcccggtgagcgatccggctgtgagccgtcctcagcagacgctccaggctgcagggacattgagcgccttggtcccagcctgggtggcgactacagttgtctaccacacaactcaagggagaagagagatgggtgggtgggggtgtggggccgagcagggccggtgcccctcgcccacgtgcctcccgtggccgggtcgggcaggaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagaggtgagcaccgggtgggcccggccatcgggtgggtggggccggggcccatcctgggcatggtggacatgcacccgcgtgcatgcgtgtgtgggaagccggggcacttccacaccatcgtggacacactctcagcctgcacacccacacccatacccatgcctgcaaagcagagctaaccctcagtccaccattgcaccagtgcggtaataacagtgtctacctccagggcctttgcgaggatcgaatgagtcggcacctataaagggcactgctagggccgggtgcggtggctcatgcctgtaattccagcactttgggaggccaaggcgggtggatcatgaggtcaagagatccagaccatcctggccaacatggtgaaaccccgtccttactaaaaatacaaaagattagctgggcgtggtggtgggcgcctcccagctactcaggaggctgaggcaggagaatcgcttgaacccacgaggcggagcttgcagtgagccgagattgtgccactgcactccagcctggggacagagcgaaactccatctcaaaaaaataaataaataaaaataaataaagggcactgctagtaagagctttgtacacatcagctgctccccagactccctgggccaaattcatggcccctgggaaagtgcccattgccagttatctggaacctgccctttgtttacgtgctgcgtggttttctatttttaatttttttttttttaaagaaacaaaaacgaagatgtgacagagatcacttgtggcctgtaaaggctaaaatccttactatccggccctttactgaaaagttttgcagtttcatttgtggttcctcatccccaaactcttaccctcacagacacaagttctgcactccccaaggcacgtttttgctgatctgtgccctctggctggtgcacacaccttcccagtgtgcccctggctcccacattcagtcatttgacaggtgtttattggacagtttctcagtgacaggaactgttagtagcacttgggattcattagcgaataaacaaggcagagatccatgctctgtattctggttggagaagagagacagtaagtaacaatcctgatgaaatctagagcatgtgggaagatagtgtggtgggcacaagcctgccgcagctccagggggttgggagtgttggggtgcgaggtgcagtgagcagggaggtttgaacaaactgagggaggccgccatgcccagacgtggggaagggcattccaggcaaagggcaccgcctgtgcagaggccctgaggtggtcccgtgcctcgtgtggtgcgggcagggaggggatgagcagaccgtgccaggccttgcgggctgccaggaggacttggagttttaccctgagttgggtgggagctagggggtgctgtgagcagaggagggggaggacctgactcaggggcagagaggacaagacagtgggagacaggagggagcgagggcctgggcggagctgactattcctgcctgggggtccaggtgagtgatgctgcggctgcttcccggtggcagaggcagagatgaggagtgcggtggattctggagagattctgacaccagaactgccagggtttgctgatggattgggtgtgagagaaagaggagctgctggagaggacagtggaggagccatatgtgtgtgcacatggggatggggacaatcaggccacattatctttgagatgcctgtgagacctcagcacgtcgagggtgcaggcataggtctagacttgggagtcgtagcgtgtgggtgatccctaaagccttgagactggatgaaggcaggagttttgcctgttttgttcactgctgtgtccccagccccacgcctggcacacagcaggtgctcaataagcgtttttgaacacatggtcacctggctcatgcccagctgggtcagagaagcatgctttgcccctgggaacttggctagtcttctcccagctgaccccgccttccccgccaccccagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgtaagcctctgcccctgtgatgcccgactggatgggctgggtgggtagagggtccctgacccctgatccagcagcatctccccctccccaggcccgctcagcagggaagtggccgctcaagtggtacgcacccgaatgcatcaacttccgcaagttctccagccgcagcgatgtctggagctatggggtcaccatgtgggaggccttgtcctacggccagaagccctacaaggcaggcgcgggcagaggcaggtgggcggtgtggtggggagggggatgaggaggaggacactggtcactcacaggtgtctctgccccggcttgagcagaagatgaaagggccggaggtcatggccttcatcgagcagggcaagcggatggagtgcccaccagagtgtccacccgaactgtacgcactcatgagtgactgctggatctacaagtgagtgccagtggggaggggacccggctgggctgacccctggaaagtcctggtgcccgatgagttgatgtcaatataactctacccaatgtcatctcacccaaagcccttcacccagttcatagcctttgcagctgccccctacccccacacccagctctccaacacaccagggtttgctgtcctgctccagtgtgccacaccctgccatcccacctgtgggcctgtgcctcagcatctaaaacctcagccatcactcaacacatggaccctgcaacacgcaaacaggtccatactctgctactcaacctatgacactgacactcagggcatgagatgattctccagtacccaacactccagtccccaccagccagcacacagcacccaactaccagacaggtgagcactgaggtaccaaatactcatctattccagcccccacctctgcctggttgaagcccaaccttcagacatctcaactcctaacaccatcagtatcccaacttcccatcagacaacaggcaacacacccccagacaagcggacgccctagactgcccatgcaatgtgtggacactgtaacgcatgaccccccaccggccagcacttagcatgctgacaccccaacacccaagcagcccaacagatagacaccctctctggctggcccaccctcctgcgacatgtgttaattccacctccatcaggaaacacccagggcaccacaccccagtacccaaagaggctagcacctagcaccccaacacagtccatggataccccatgcacagtaccgttaatactgccgctccccgctggccagacccactgccatgctccaggcttctgctgatcaccagccttgcactccctctcatctaagccccagcacactgataccctggccccaggtgcatgcacagagcatcagctttctatatcccaggtccccgtggtcaatagttgccactctgacaccaagtccactcagtcccctgagtcctcactggtcaacgctcggtagaggggtcatcccagcaccctgtgtgtgggcagctctgcctccttaggctgtgtggcattgcccaacgctctcacaccccagagtcctctccaccacccaatgtcccgccaccccaacagccctgctgactttctgagccccaaaagtctacctcagccaagcacagtgcatgcccacccactggtgaagctgggtcctgggggcgtggtcagcagcctggatgtaccccacgccccacaggtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttg

SEQ ID NO: 2175 - DNA, 5455 bp, Homo sapiens
tgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaacttggctgcggcaactttggctcagtgcgccagggcgtgtaccgcatgcgcaagtatggccgcccctgccgtggtgggagcaccgccgcctggggcagaggggagtggcttcaccgggctgtgggacgggagccgggatgtctgtctcacagcagtttgcctgggaaacagactctggggcaggacgttgcacgctggaggattccctgagagagctcgggacacctgacgggggtgggatggggcctgggcagggggaggctgtggagctgaagttcccaacccaggggagctgcagtggggtccccgatccctgagtccactggcccctgacaggctgcccctggggagggtgtcactttggattctttttggcgatgggctgttcccggtgagcgatccggctgtgagccgtcctcagcagacgctccaggctgcagggacattgagcgccttggtcccagcctgggtggcgactacagttgtctaccacacaactcaagggagaagagagatgggtgggtgggggtgtggggccgagcagggccggtgcccctcgcccacgtgcctcccgtggccgggtcgggcaggaagcagatcgacgtggccatcaaggtgctgaagcagggcacggagaaggcagacacggaagagatgatgcgcgaggcgcagatcatgcaccagctggacaacccctacatcgtgcggctcattggcgtctgccaggccgaggccctcatgctggtcatggagatggctgggggcgggccgctgcacaagttcctggtcggcaagaggtgagcaccgggtgggcccggccatcgggtgggtggggccggggcccatcctgggcatggtggacatgcacccgcgtgcatgcgtgtgtgggaagccggggcacttccacaccatcgtggacacactctcagcctgcacacccacacccatacccatgcctgcaaagcagagctaaccctcagtccaccattgcaccagtgcggtaataacagtgtctacctccagggcctttgcgaggatcgaatgagtcggcacctataaagggcactgctagggccgggtgcggtggctcatgcctgtaattccagcactttgggaggccaaggcgggtggatcatgaggtcaagagatccagaccatcctggccaacatggtgaaaccccgtccttactaaaaatacaaaagattagctgggcgtggtggtgggcgcctcccagctactcaggaggctgaggcaggagaatcgcttgaacccacgaggcggagcttgcagtgagccgagattgtgccactgcactccagcctggggacagagcgaaactccatctcaaaaaaataaataaataaaaataaataaagggcactgctagtaagagctttgtacacatcagctgctccccagactccctgggccaaattcatggcccctgggaaagtgcccattgccagttatctggaacctgccctttgtttacgtgctgcgtggttttctatttttaatttttttttttttaaagaaacaaaaacgaagatgtgacagagatcacttgtggcctgtaaaggctaaaatccttactatccggccctttactgaaaagttttgcagtttcatttgtggttcctcatccccaaactcttaccctcacagacacaagttctgcactccccaaggcacgtttttgctgatctgtgccctctggctggtgcacacaccttcccagtgtgcccctggctcccacattcagtcatttgacaggtgtttattggacagtttctcagtgacaggaactgttagtagcacttgggattcattagcgaataaacaaggcagagatccatgctctgtattctggttggagaagagagacagtaagtaacaatcctgatgaaatctagagcatgtgggaagatagtgtggtgggcacaagcctgccgcagctccagggggttgggagtgttggggtgcgaggtgcagtgagcagggaggtttgaacaaactgagggaggccgccatgcccagacgtggggaagggcattccaggcaaagggcaccgcctgtgcagaggccctgaggtggtcccgtgcctcgtgtggtgcgggcagggaggggatgagcagaccgtgccaggccttgcgggctgccaggaggacttggagttttaccctgagttgggtgggagctagggggtgctgtgagcagaggagggggaggacctgactcaggggcagagaggacaagacagtgggagacaggagggagcgagggcctgggcggagctgactattcctgcctgggggtccaggtgagtgatgctgcggctgcttcccggtggcagaggcagagatgaggagtgcggtggattctggagagattctgacaccagaactgccagggtttgctgatggattgggtgtgagagaaagaggagctgctggagaggacagtggaggagccatatgtgtgtgcacatggggatggggacaatcaggccacattatctttgagatgcctgtgagacctcagcacgtcgagggtgcaggcataggtctagacttgggagtcgtagcgtgtgggtgatccctaaagccttgagactggatgaaggcaggagttttgcctgttttgttcactgctgtgtccccagccccacgcctggcacacagcaggtgctcaataagcgtttttgaacacatggtcacctggctcatgcccagctgggtcagagaagcatgctttgcccctgggaacttggctagtcttctcccagctgaccccgccttccccgccaccccagggaggagatccctgtgagcaatgtggccgagctgctgcaccaggtgtccatggggatgaagtacctggaggagaagaactttgtgcaccgtgacctggcggcccgcaacgtcctgctggttaaccggcactacgccaagatcagcgactttggcctctccaaagcactgggtgccgacgacagctactacactgtaagcctctgcccctgtgatgcccgactggatgggctgggtgggtagagggtccctgacccctgatccagcagcatctccccctccccaggcccgctcagcagggaagtggccgctcaagtggtacgcacccgaatgcatcaacttccgcaagttctccagccgcagcgatgtctggagctatggggtcaccatgtgggaggccttgtcctacggccagaagccctacaaggcaggcgcgggcagaggcaggtgggcggtgtggtggggagggggatgaggaggaggacactggtcactcacaggtgtctctgccccggcttgagcagaagatgaaagggccggaggtcatggccttcatcgagcagggcaagcggatggagtgcccaccagagtgtccacccgaactgtacgcactcatgagtgactgctggatctacaagtgagtgccagtggggaggggacccggctgggctgacccctggaaagtcctggtgcccgatgagttgatgtcaatataactctacccaatgtcatctcacccaaagcccttcacccagttcatagcctttgcagctgccccctacccccacacccagctctccaacacaccagggtttgctgtcctgctccagtgtgccacaccctgccatcccacctgtgggcctgtgcctcagcatctaaaacctcagccatcactcaacacatggaccctgcaacacgcaaacaggtccatactctgctactcaacctatgacactgacactcagggcatgagatgattctccagtacccaacactccagtccccaccagccagcacacagcacccaactaccagacaggtgagcactgaggtaccaaatactcatctattccagcccccacctctgcctggttgaagcccaaccttcagacatctcaactcctaacaccatcagtatcccaacttcccatcagacaacaggcaacacacccccagacaagcggacgccctagactgcccatgcaatgtgtggacactgtaacgcatgaccccccaccggccagcacttagcatgctgacaccccaacacccaagcagcccaacagatagacaccctctctggctggcccaccctcctgcgacatgtgttaattccacctccatcaggaaacacccagggcaccacaccccagtacccaaagaggctagcacctagcaccccaacacagtccatggataccccatgcacagtaccgttaatactgccgctccccgctggccagacccactgccatgctccaggcttctgctgatcaccagccttgcactccctctcatctaagccccagcacactgataccctggccccaggtgcatgcacagagcatcagctttctatatcccaggtccccgtggtcaatagttgccactctgacaccaagtccactcagtcccctgagtcctcactggtcaacgctcggtagaggggtcatcccagcaccctgtgtgtgggcagctctgcctccttaggctgtgtggcattgcccaacgctctcacaccccagagtcctctccaccacccaatgtcccgccaccccaacagccctgctgactttctgagccccaaaagtctacctcagccaagcacagtgcatgcccacccactggtgaagctgggtcctgggggcgtggtcagcagcctggatgtaccccacgccccacaggtgggaggatcgccccgacttcctgaccgtggagcagcgcatgcgagcctgttactacagcctggccagcaaggtggaagggcccccaggcagcacacagaaggctgaggctgcctgtgcctgagctcccgctgcccaggggagccctccacgccggctcttccccaccctcagccccaccccaggtcctgcagtctggctgagccctgcttggttgtctccacacacagctgggctgtggtagggggtgtctcaggccacaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttccctcttg

SEQ ID NO: 2176 - DNA, 20722 bp, Homo sapiens
attgttacattcccatttatgaaaacctagataagcatctataatgagaatcctaggtaagcatttataatgagaatcttttttcattcctcagcatcatttaatctgttgctcacaacatttataacacaagaaccaactgtagaaaatacagagtagaggtgagtttcaagaagcactgggcaagcacttgaataactgattttgatggtaagagctccaatcatcccaaggcagaccctcttctgggagaaaaccaaagattcaccttcaaaacgaggtgtttcaggagccccaaagcataacattctatttcctaagaaacacactctatatttctgttaaaacaatttaaaaaatggtacacatttagtagaaaatgaattgtgaaacactgcactagcaacatcatttctcaaggacacatgagaagtactttcatgttcacgacatttcttttgggtactcaagtcatttaacttttttttttgagacggagtctcgctctgtcgccaggcttgagtgcaatggcgtgatctcagctcactgcagcctccgcctcctgggttcaagtgattctcctgtctcagcctcccgagtagctgggattacaggggtacaccaccacgcccagctaatttttgtatttttagtagagatggggtttcactatgttggtcaggctgccctcgaactcctgacctcgtgatccgcccaccttggcctcccaaagtgctgggattacaggcatgagcctccacgcccggcgtcattgaacttttttattcaaaggggtagaatgtatatgtgggacaaagaaagaggctagattaacaaagctatcatttccttgtttctctttgacagctggtcaaataattcaggcatagctaggactgatgctcaagttagaaacaggtggcccatgctgtccaatatagcagccactagccacatgtgcttatcaagcatttgcactgtgtcccatgcaacaaggaactggattttaattttaataaatttaatataaatttttaaactgatacttatttcaattcttgaaaaaaacttttgtcttagctacttgatatgagaatctgttttcaactgtaagttgtatgaaatctaaatacagatcaagtatgtccaatgaacattagcatccaaatggagatgtgcagaaagtgtaaaatacacaccagatttcgaaagcttagtatgaaaaagagaatgtaaaatgtctcactaatatatttttatatgttgaaatatttggcaaatgttggattaaataaacttttattaacattttcacctgcttctttttatgtttttaaaagttgctactagaacatttaaagtgacctatgttgttcatgttatagttctcttagtgtagaggtagactgttatagagccagtgaaacttgacttataaatagctatgtaaccgtattttctgaataatcacctagctatccagagtgagtaaacactcacttacttaaatatttaatttcctggagaaaatgtggattggtgggctttgaaaagttggtaaaaactttgtgttttaagaataaaattaaacagtttaaacgagaacctgaaataatacttagggcttaacagtgtttgtaaaaaattgttatctttgctctagtcaggcctgatttaacattagtttggttgatacatataagatatatatcattttggaagttttgtgaattacatataataaaatatagcttagcaaatatgcaaccaaaatgtttttatcttctctcaaacctgaagaattctctattactctaacctccaaataacttatttgatttagggagaaatcaaggatgtctaaaacaaaacaattgatggaaaggctctattaattttagagtagattaccccctactccccatcagcattgttaatttagatatactagtgcccaccttcttttctcaaaaatcccctaccagcttacatgaaagtggtaaaagaattcaataagcttagcttgaaaacctaacccaaacataatttaatcttttgatgatgatttaaaaatcatacaattacagacacatgctggctacaaagtctctgaggctcaaagttttaagattagatgaagattagctgggtgtggtggtacatccctgtagtcccagctactagggaggctaaggtgggagggttgcttgagcccaggaattcgaggttacagtgagcaatgattgtgccactacactctggcctgggtgatacagtgagaccctgtctctaaaaaaggaaagattaggagaagatattcactttgtgggatttaactagtctgcaataaaaatgaattataagcttccatctccagaaagttatcagacacaacacgtagatcaacattttcaggagatcagttagaattcagtagagtatatataagacttaaattacactgaataaagttttatgttccagaatagtgaagaaagctttaccttcatgaaaatcaaatctcttttctgacaaaaattcagaatttagggtgaatgtcttgatccaattttgtattttaaacttaattaaaattttgatagccttctgttgaaaaatatgtaaatttatgtttctcagaaaagacgaattcagaattttaagaaatcctatgcttttggctatcttgttacatgaattttgagttaaaatactgagtttatgagtttgaatctttctgaagtgttaacacaataagcccactgtactgcataaagataaaacgttgagggttactttgtcttaggggactggaaattattaaaagggcaaattccccatacattgtgatctgtcatatttagccctgacttgtcttgtggtaacaactgtgttgcctaagaaaaataagaaaatagaacaaaccattctgcccagttcaaccaaaatgactccctttgtcctagaaaacaaaaaaacataactggggaggttggcaagaccataacctatggctgtgaacatttaaaccttacagaaaaactgagatcaatgcccccaaagaaaaactacccgagtctttatgagacattgcagattaaaatgaaaaccattcaataatattgaaatgctcaatacaaatcagtaccttagacaagacatacacacatcttgctacctggatggagggcattataaacatcagttagccatcacagctctcacagaagcatctgcaagtcaatggtgtggagagcctgatttcaagcgttcaaaatccagtcagagctggcttataagaagagcccaatcaagcagtcaaacgtgtttacaggtcagctctgctcctggccaagtggcgttggctggggcacgtggtgagtgggtggtggcggaccaggctcctgtgtcagctgcaggtgctgagctggatctgaagtacttgtagctaaatggagctcctctgtttgctcttgatgggcatgaagatgttccagtgtttccttggacagagtgatcacgtgcactggctctgtttgtgagggccccatctggctttcaatcatattgaggctctgaatgtgttctgtttgctcctgttgagctgaaagaattaaattctgcagttgctctggctgctgcgtgagcagggtaagattagcagcctggtctgcagtcatgttttgggaactctctgcagtcacaatgctgattccctggctaggaccgggcatgaaattgatgttatgtacagaatcggttacgagaagctgaatttcctgctctcccgaggtagagagttgatatggctgtagctgaagaatattcctgacctcttctgtattactactgccagaaatgctgctggcatctgaagcatgcttctccttgctatgaattttcaagtgagccttcaagttgtctaagcgagcaaactgtaagttacactcagggcaggagaaaggcttcttgccagtgtgtagaatgcagtgtctccttttggcactggagtcagagaaggatttgccacaaatgccacaggagtatggcttttctcctctgtaagaaaataaacattttatttttaaaatggaaatacctacttactacttcctgattatttagggggaagcaatcaagagtagtggaaaattaactagactgcaagtcataagtcatgggttcacctactaattcaaggacttgaagcaagtctcgcttccatgggcagtttttaatctgaaaatagggtgtgggtggtgcctgaggaagggtggcagatggggcacggctatatatgataaaattttatgattccacagtatgtatttcagataagaaaagagagtaaatatttatacaataaacatatagttctcttttgttttgtcttagttttcagagccaatttttagactctaatggcccaataagtatctatgattaatgtcaatttaaaaaatttaagcatcctctaattatttgtgatgctgtcagaagaactcctaagtccaacctggggataactgtgtaaacaaaaacatttattcagaaaacatcaaatttaatacttatttttgattgaagatttaagctttggaccaatccgtagccccaatcaaaatttaataaatgaaatcagtaatgtaaacttttactggccagaatcagcattcctttttacctaggtgaggaatttcattattgaaaagataaaacaaaataggccaggtgtggtggctcacacctgtaatcccaacactttgggaggcccaggcaggcggatcacttgaggtcaggagtctgagaccagcctggtcaacatggtgaaatcccgtctctaccaaaaaaatacaaaaactagctgggtgtggtatcccagttactcaggaggccacggtgggagaatcgcctgaactcccacctgcactccactcacaccactgcactccagcctgggcgacagtgagaccctgtctcaaaacaaacaaacaaaacaaagccaaagtaataaactgcacacaaaattctgcaaagtaacaactgggagaaaactatataggtaacacatgtcacctcactgaacagcagaactgaatgaggcctccatgcgagaaaaatatctgcaaaactttaccgatggattctgatgtgggtctgaagagaactctttgctgtgaaagatttgccacagatttcacaagtaaatggcttctcacctaaaaaaaacaaaaacaaaaacaaaaaacccaaaacaaaaaaacatttaacaatatacattcagaataagacaaaattaaaaaaacacttcggtttcacaatataaacagaacaaaggcaatcccctccgtaagcgtaaacgaatgatgcactcaccaaatatctactctgtaactaacctaagcactgtgtgccgagtgccaagagcatacacagaaatcgtaaggcatggttctcttaaaaacctgaaaactgcaacaaggaagtgagttacactgtatttactcctgttttctccccttagatattacagcacctatgctctcctgccttattgcttggctaggtagcccacttgaccctgaaaggactcctgtgtgctagggtgagttatgtattattcatgtttatatcaaccttccaaatatatccagaatctgaccactgctcagtacctccactgccactctcttgtccacaccaccaccatctcttgcctcttatggggtctccatttctgctcttgcttccctgccataaactatcaatatggccaccagagtgagccttgatgcagtcaggtcattttatgcttgggctgcaaatgttctgatgatttcccaccccaggataaaacccaaagttcttgccctacaagcgatcatagatctgtaccccataaaccctactcctcaccccaaacttcccggatctcatctcagggtgtctcccagcatggttcactctcctcatctccttcaagtctctgttcacatgttattttatcagtgaggctccatcaccaccaagagcactacaaaccttgccacgcactccttagtccaattctccaatttagtttttccacaatgctattgctgcctcatataatgtataagttatttattatccatttcttcctttttaagataacttgtgggtatgtctgctcctagtaccccagtgccgagaatctggcctggcatgccatttcagaaatccctgctgaatgaacttcatgggagtggcacacctgagatgctataactgctccagaacccaccaggcttcactaacatcagcaagtgcttattcagtgtgtttgcatgctgaacatacaatgacagactgttcatgttccccagaaacaaaattaagtaatccaatgcaggcaagaaaactaaattggaaaaaaagaaaaaaaaaaaaaaagcaagcagcaaaatccacttaactggagaacaggagaacagcaaaggataagtacaatttgaaatggaagatggtcagtgagcttccctttcacagcatctactggaaaattcaggcaagacatttctccaagctccatcgaggcagaggacagctgtaacaactcggatgaatctgcatctttgcatcatgaactcttaccactacaaagattaaaaccaggcaactgccataatctgtctatagctttctacatcagagctggggccttctctgatcttggttggttttctccctctccagattcaaagactgagtacctgctgtttgcttgtgattgtaaaattcttgttgcagttttcaggtttttaagagaaagaacagcaacaatcatccataacaacattaactataccattcagctccagctgagtttctatttcagaaagtctgtctgatggcaaatgttttttgagggtaagtgtttgcaggagcaacatcctgcagtggaagctctttgagggagtgagcaggacagtgggaaggcaaatttccctagccaaggtcaatctgcagggggtcttcccgcttagtggtttctgatctgttcccctgtgcacagctctaccaccttcaatggagacacccattccttaaatttatttagttctcaaacactgatagaccatcaataaagtacacagctaagaaacaaaaaagaaacttttctaatctacttgaggagatgcacaaactaattaagtaacatagggctgtgtttcactgaacattaaaacgagtggcgtcaacaattctgagtgcagacagggtgctggatggggtgggcaggatctggctagactggaaagaagcctgggccagggtactagtctaaatagtatgagcagaagctggtgtcagaaatgactacacggtgtgcaccagtgaccaaggatcactgtcaggagtcaggaggccaaggcaacaggagctatgaaatccaggcaggggacctgtggagcctctggaagtttttagcagaatgacatgctgaaagtactaagaaaatacacctgggaatgatgaggagggtgggctagaggcaggaggacctctaacaggctatgcacaaggcctggaccaggaggtggcaggaggcagacggagaaggataaggtaataggacagggcctgagaggcatggggaccggaaagaagtgtgttacaagaggattagacaatagcgattaaaggaaaaggcagagacaggagtgtgatgaaaggttccacccagggtgatgtcaacagaagtactgaaacagctccagggtgtacttccagaccctcttctcagcagttactacaccaatcccacccacccagggtgatgtcaacggaagtactgaaacagctccagggtgtacttccagatcctcttctcagcagttactccaccgatcccacccctacccttccccagtgacttaaatcccggaccccactccagataggatcgatgagtcactgcttattggcatcacagctggatttcccatgcccacctgctgaaacccagaataacatggggcatgacatgttaatgacaacatcacccagcccctgtccagccaggcacaacaatcacagtgacacctcccattccctcagctgtcacattcacctggcagtccagttccgtccgtgtggacccctcagcatcctgcctcccactgtggaccacggctttgtttttcttaaaaaattactgtgttcattgtaaaagaatcaaatattgaaaatacaaagaatattaaaactgctccactattctcatctcttgagacaaccagttaacaatggcgaatatctttacagacaaatctgtttatttgcggtcttactgtgtgaggtcatccaatgcatgccgtttgtcacatcagtaaagccacaccaccattttaaaaccctgtgctgtgtaccattgtgtgtactgccccaaatttacctatctaatcccctcctgggacattcaggtggctgttaagcttgttaagttataaacaatgctgcctatgatgaatatccttaggcaaacatcttttcacaattgtgcagtttatgttttggtaagtattgcaaaagttccttccagggggttcccaaattatattcccaccaacaataaataaagatgtgcatttcctcatgtacttgccaatcttggcaaaaaagggacacatgtccatgataactgtggatagcatggtttgacacctgtgtacttggcattcctatatggtcttctcagctgtttcctgtcctgtgttcacacctctgctgtggctctgaccacgccatactgtttcatagtagatggcacgtagactctgtaagggcatgttatggtgaggggcccccaggtctcaggaagatgggaagacccccaggtctcaacgttaatggatggtctcaacacacagttgaagagatttgggaagcttcaacttcaagccacaatgaggctgtgaacagaactgtgacttactgaactttatcatttgttccctgacagggccatctacctgtgagtaggaaccctcagggcagaatcagtgtttatggaacaccatccaggaacagggacactggcggggtgggactgtgctgtggggtcagaggtcactcaccaggcttctctgtgacctgggctaattcccttgacttgttcccagctcaccatgcaatcttctgatcactaacttggctttcgggtcactaatgtgaggaaggaggtgctgtgggcaacagaaaggtgtaatccctctattgagttgatatatcctctggtttatctgtcctgtgaactcatttggcttgattgggtccctgtaaacctgaccagtgccaggtatggggacaagatgtgagcagaagggcctgagatgtggtgacctggcaggtactgcttgtctgcctgacactttgcctccatgtcaaaatgtgttcacctccctcactggggatgcactcctaggaaagggaacatctctaatttgcctttgacttctccagtgcttggtgcaggacatctaacccagagagtttgtgcctaaagatctaagagatgaatgacagctcatctctaagagatgaagtcttggtttccagctgagcatggccctgagagtaggactggcacttctcactctgaatgcccagggagcagggaaatggcacgccaatgcccttcaccaacattcaagcagattctccatgctgatgctagggacagatgggtcatagttgctgctcttgaagaaccccaattttttgataggttcaatttcttttcatatttctaagtcatgcaaaccacagaggcccgtctgtctcctttttaactcatcacacatcttccactttctgttctgcttctcaaagttgacaggctgagaagagtttgctggaattatagtgggggaggtcttctgttccttttcatccccacttcaagtcctactgctactcacaaagcccagaaacctcactcccccttatgctcaggcaacagaaccaaggggaagtgcctcttctggcactgctcagcatgaccaagccagctccacgctcctccaccaccgctgtctccctagggaactcagcacagcgccacccactatttgcaggcacatgtgcacctgtggaaatccagagctctggctgcatctctcccccgaattctccagacctggaaatctaatgatctaccccacacctgcacatggatgtcaaatagacaccaaccagtccacaatctaactcctgatctgttcttcttagtcttccctagcttttcctcctcacagtggcttttgcctcctctttcaactcccacatccaatcatgagcgaatcacatgaattcttccctggactatctccagaactggaccacctgacaccacctctgctgctactgtgctgttccgagccccactactgcacagcctcctgatgggtctctctgcctccaccctggcctcgcccccacctcacagggtggctagagtgaccctattacaaccctaagtcatgccatgtcactcatctcagtaaagccatctccctcagaataaaatccaatctttactgtggccttcaaagtacttcagcccgagtgcaccctacaactgttgaggggtactttaaaaaacaccaattcccaggctctgcccaggtgaagtcaatcagaatcttggcagctgggacaaggcttttttttaaagcttcccaggtggtaaaaagcatgcagctaaattgagaacatccacctacactatgacttcctactcccagctctctggctgccttgatgctcctcccagcacgtctccagcttgtcaaaaacatttattcctgcctgagggccctgtgcccagggctccccctgcctagaatgctctctcctggacatcttcaatggccggctggctcactcccccactgcattctcatctccatccaagatgccacctcatctgtgagaccttcccaaaccagtccatgcataaaagagcaactctctttccggcatcccgcccccttaccttgcattttattcttcaacgcactcacaacaccaaatgtgttatatacttgtctgtactctgtcttccctattgaatgttggccccttaaggcaggggcctgtccatctcattcactgctgtatcctcaaagcctaaaacaatgtctggttcccagtaagtgctcagtacatgtgttaaaatccatatcctatgagatgtttactgaatttaagaagaaaaacttgtatttaaaaaacaacatccaggccaggcacagtggctcacgcctgtaatcccagcgctttgggaggctgggagggtggatcacttgagccaggagtttgagcgagaccagcctggctaacatgccaaaaccctgtctctacaaaaaaaaaacacaaaaattagccaggcgtggtggtgcgcacctgtagttccagctactcgggaggatgaagcaggagaattgcttgaacccagcaggcagaggttacagtgagccaagatagcaccactgcacaacagcctgggcgacagagacagtgactccaaaaaaaaaaaaaaaaaaagtccaaagcaccataaatcaatttgctatttagataattccagtagacaacagaattattaaataacctgtaatggcaagtttttcttagaaaactgaataggcttatttttaacatacattctttgacaaaaggtataaaagatccaattttccgatcttacataaaaaaactgacctgccctaatcaatgctgcctcctcgtcatctctgaaactgatttttctggaggtggtgctgcttaagtttaagtgttggttctaggggagaaagtggaaacattctcagtgtctatgctacatttgtgtctgttacatttggctgtcttttctaaaaaaataatcttgggccaggcacagtggctcacgcctgtaatcccagcactttgggaggccaaggtgggcagatcacaaggtcaagagatcgagaccatcctggccaacatggtaaaaccccatctctactaaaaatacaaaaaaaattagctgggcatggtagcgcacacctatagtcccagctactagggaggctgaggcaggagaatcacttgaacccgggaggcagaggttgcagtgagccaagatcgtgccactgcactgcagcctggcaacagagcgagactccgtctcaaaaaaaaaaaaaaaaatttatcttgctgggtatggtggctcatgcctgtcatctcagcattttgggaggctcagacaggaagactgcttgagcccaggagttcaagaccagcctgggcaacatagtgggacccatctctacaaaaattaaaaaataaaaaattaggtagtgtggtggtttgcacctgtggtcccagctacccaggaggctgaggtgggacgatcacctcagcccaggaggtcaaggctgtggtgagctgtgatcgtgccactacactctagcctggatgacagcacaagcccttatctttaaaaaaaaaaaaaaaaaaaagtcttgatatcaccttcaatgctgaagtaaattaagagtgaaacatagaaccagactcagactcactattctgtggtattaaatgaattgtgacatacgaatagtcctcagtaagtgatctccattttgctcatctacaagagatgtgatttccccaaagacagtgctgacaacattctgccttccaacttttaacttatcttcttacacaactcccatccaatttataataaacatttccaaacacaggcttagcagggcactcagagaacttcattcttcactctcctgaaaacatcccgtgtactggggggacagacgagatggagttttacctgtgtgtgttcgcagatgtttctttagctgagacacatccatgaatttgcgatggcagtctttgcattccggtaatgagtggccttgtcgcaacaataaaaaaagtgtcagtgcatacatgctctccctgccttttcttcagtgatttgtgttaaagcacttccctgaaaaataatcactttaaatatagtactttaaccacaaaaattttttcattaatttggtaactgttaatattttcctaagcacctcaactcactgcctcctccaagagagctaggatccttccaattctaaatgtagtctctccttttttcctcaaagtattggtgtgactgaggccacaaatgacctcaaatgacactcgtaacccacattcatttcttatcagttggcaggaaagaaaaaggacaacaggtagaaccaggggagagaaagcctgggctgacagccatgggatgatgatgtctctgcccaggcaccactaacaaccattcactgaagctcccctgtgcaagtggcacttttgaaagatgccaattctgtagggtttctgtgtgtggcaccaaaactgtagtatacaaataaaacataattcacatggtggcggacaataacataaaaacatgtaatttagactcttaaggcacttttccctaaataccctatgtgaacgatatgtgctaagagcagaacaatataaacctaatgtttcagaaacaattcttatttgcatttcttcccccccaatctaaatgttctcactttatcgtacctgtatgaactcggtaatggctctttagctgtctgttctggctgaaatattttccgcattgatcacaggtaaaagacttctgtcctgccaaaaaaaccaaaacactaaaacatgtaaaaaattataaagaactggaatgctcactaataaggtaaatactacagtgggtccaggtccccattttctacaaatgatacaagcgacttgtttacatacccagaagccttcaatctaccacagaaacataaatgtgcaaaggtatgtaaggcaatcgggagtactggagactggggtagaactggagaatttaagtttccccgaaaggcgttcaaagtaaaacaattctaaactttggtggtttaataaaacatgcttgcacactaaactcccagcagccagtttataagctctagtttaatgatccgtgcagaactctaaactgcactcagacagatgcaaaatcctgtctttcaatgacaccacgttggaaatgatactaggctgagaaaacaccatttaggtgttggtaatgcccaccctggggaatgggaatctggtgaagctggccctctgggcaagccccactacctgagtgcaggctcatgtgctccagcagtgagtgcttggtggtcagagccttgctgcacacggtgcaggtgtacggccgctcgcctgtgtgcatcctggtgtggacctgtagcgagtgcttctgggcaaagccttttccacactcattacatttgaaaggtcgctcccctggaagaagagccccagaagcatggtataagtaagaatccacacatttttctgtctctcccaaattaaaaaaacaataaaggatttttcttaaaaggcacacatccaaaaggccaacaatgaacacaagagacatcagcaataaaattttggaagctgaacagatgaatctgaagccagcagtgagtagcactaacataacctaattttttgtttttcctttgtaacagggtctcactctatcacccaggctggagtgcagtggcgctaccatagctgactatagcctcaacctcctgggaacaaatgatcttcccacttcagcctcctgagtagctgggatcacaggcatgtgccaccactacacccagctaattttttaattgtaattttaattttttttagagatgggatctcactatgttgcccaggcaggtctccaactcctgggctcaagcaatcttcctgcctcggcctcccaaattgctgggagtacaggcatgagccaccacacccagcccaatacaacctaatttttaagacacaatctcctaaggctcaggaattggtggcacctgctatctctggaaacaggggtgagggagggtaaatgaaagtctgtttcaaaggtgcttagacccctgatcaaatcttccactctacacagccaggagactgtccctcccccaaaagagaatggagagtgttcactgaggagggttaagaaaaaggggtctttggattaggagtttctaggcacagttgagttgggatcaccacagggagagtaagtcaacatttccatctgggatgatgagactcccccactccttcttccccatcctgtcctagacacaggccagcagccaggcctagtgcctccaagtgggagagcagaagcgtcttccagtggaacatgagaggtccaaggtgagagagcaaagatgtggaagccaggcaccagtaaggacatggggcacagccacaccacctccagtgaggttatgacaggcctccatacaactgtttcagtactgactgagtggttaagttaaacattaaaagccagtgcccttaaacaaaggctggaatgtaacaaaagcccaccaagagtttcccctaggcttctcctgggccttaaagcatgacaaaataacgaaggaattcttaacagggcccacttaggattaaacaagttttactggggatctgaaggaactccccaaatctccgtgatttagcagaagataagggtaatcaccccagcacctagacccatttagattaagtaaacttactgaggctccagaagaaggtctttgggacgcagaccttggatatagattaaaagaagttaatcacctacgtctttagaggaatgcacacttacagacagacatacagcttaggcggtatataagctctgaaaaattctgtaattttgagttggtctggcgataatttccaggccttctccctataactggttacagaaataaaaactctcttcctctccaattcatctgcatctcattattgggccacgagaaatagcagcctgactctcagtgtgatctgggaacaaggtcacagttttacagactctctcatacaaaaaaaattagccaggcatggtggtgcgtgcctgtaatcccagctacttgggtggctgaggcaggagaatcacttgaatccaggaggcggaggttgtggtgatcggagatcacgccattgcactccagcctgggcaacagcctaagaaataaataaaatacaggctctctccacacatgcagcattgccagtagcttttagcaacccacccttacatatgatttaaaaaaaaaacaccaggcactcaaggagagccttttgtaatagtgacagacaaacaagcaagaagaaaaaaaaaagcaacttgcctccagtgaggaaaatgttgttatcattaacatgctcatagaggtaagataatacattgtgaaataaaaagatcattcaaattaaaacatttagaaaaaaaagagctcctaaagggggaaaaaaataagagttgaaacagaaaacctcaaagggctgaaaaacaaagtggaaatcccccagagggtggggccaaaaatgatggaaaatataagagaaaataaagttagagagaacagagaaaacagagaggagaaatcatctatgaaataactcaagattttccagaactgaaagacagtttccaaaccttatgaatctacctgttatctacccagatggaagaaaacagacccatactaaagtgatgggctgcaaaattcagaatacagatgcttcctgacttatgatgggactacatctaacaaacccatcatactgaaaatatcataaggaaaaatgcacttatacagagtactgtatgaatgcaccaaatgcagagtactggtcatttacccacgtgactgtgtggcccggcatggcatgagaggatcatactgaatattactagaccgggaaaagatcaaaactcagaattcaaagtacagtttctgttgaacatgtactgctttcacactattgtaaagatgaattgaaccattgtgagtcggggactgtctgtactgaggacataagggaagaacgatcctacatgctttttcttaagtcttgtataatgatttaactctaaactatgcacataaaatttttgataaaaatagccagctgggcgcagtggcgcacgcctgtaatcccagcactttgggaggctgaggcaggcagatcacgaggtcaggagtttgagaccagcctgaccaacatggtgaaaccccgtctctactaaaaatacaaaaaattagctgggcgtggtggcgtgtgcctgtaatcccagctactcaggaggctgaggcaggagaatcacttgaactcgggaggcggaggttgcggtgagccgagatcgcgccactgcactctagcctgggtgacagagcgagaatccatctcaaaaaaaaaaaaaaaaaaaaaaaaaaagctaaaatataacctattacagttcaacaaatatttctcaagtatccactttgttcgaagtacctgaattcaagctcttcaacctatctgtagctaaagtctttagggagcttttaaaagcaccaaggctccagacaactaaatcagaagctctggggtggaggtctaggcactggtagttttagaagctccctaagtgattccaatttgcaggctgagaaccacagcaccagatactgctggatcacaggagaagacttaagccccagtccctatacttaagattacaattaagttgagggatatacaagtggtaacaacaatctgatccaaagcagagtgggttttaagcacctgaaagggctcaaaggaggaagggatttctcactaggactgcagtgtccaatacggtagccactagccacatgtggttattcaaatttaaatgaattaaaataaaatttaaaattcagtttctcagtcacgctagccacagttcaagtgctcaaaaaccacatgtggttactggccaccatattggacatcagagatgtaggaacatttccatcatcacagaagggtcccattggtcagcgctgggctagagggaccaaaaatgagaaggtatttaaagctagatagctgagttacaaagtgatctacacagacttgggcaaaagcatggttatggtcaagatgaagaatgttcaagaatcagaaagcagggtacattgggctagatcttgataagtggacattaaaggattcattcaacaactacaaatgagaggggttcttgaaccaggctacctgggttcaatcccagctctgtcactaacgggtgactctggcaagttatttaagctccctagaacttggttgcttcatctgtaaactatgcactttagcaaccctctcttacatatgagtaaatatgattttaatcatacaatgtataatgaggatattacccaccttgcaggattgtggagaaaattaactgcaataacatgtataaaggctttattacaatgcccatcacacagaagttgcacagtaaatggaagctattattatcatcactactcccaattctgcaacacactgcaatcagctttgaaaacatcattacctgtgtggctcctctggtggattgctaaaaagtgattgtacttaaagaccttgccacagtctttacagcgggcctcagggcctccagggcgctttctccttccacagatcctcttggctgaaccatggtcctcttgatccccaacaagtttgtaatctttaagtttgacggatctccaaatcctccgcttgctgtatcgactctggcttgcctggccatcctcggtcttgggatcatagttctcatctttttcaactggcatttcctcctctctacttggctcacaagtaggctccgattcttccttttcttttgctgcaatttgctcattcagtacaccactgtctcctttaaccacaaagttttgtctattctgaactgaattgttcactcttaactgtatttcttcctctgcagccagttctgatttctcctcctgcaatgtattgactttttttggtcttccccgtttccgctttggaggatcgtttttcttattagagataacaaccactggggcaccagcagtgttcaaagttgttggctttggggagctatgattattttggaagtctgtgtaagcctttaccaggtcatagacttttaagaactgagcagtagccaggatttgttctgtacttttctcactggcatggagataacctgtgtagataaattccagcaggataccaaaggtgtctgcaaccatgccttccagcatataaatggattggccgatttccccctcttctgcaaacatcattgagaagtattcactactggcagcaagtaaggctttgtgggcccggaaatgtacattctccacgattaaagtaatgtcacagaggaagcctttcttcctctgatcctcaaaactggccagcacagtgtcactgtgagcgtctgagtgtacaacaagctgcccagaaggctctggcgatgtttctgccattttcttcagaagccactaagggttaaatctgaaataagaaaacaaggtttaaaaaggagaaagcactgtctaaaaggttaatgccagcccacatgaacttcctattcacttcacatcattaactgaattttaccattaccatttttgtctgtctacaaacttagctctgggcccgggcgcagtggcctcacgcctgtaatcccagcactttgggaggccgaggccgacggatcacttgagaccagcctgggcaacatggagagaattcatctatacaaaaaatacaaaaattagcctggcgtggtggcgcccgcctgtggtcccagctactcaggaggctgcggcaggagcatcacctgagcctgggagttcgaggttgccgtgagccgtgatcgtgccactgcactccagcctgggcgacagaacgagaccaccacctcaaaaaacaaaaacaaaacaacttagctcgcggttttttttttttgagacggagtctcgctctatcgcccaggctggagtgcagtggcgcaatctcggctcactgcaacctccgcctcccaggttcaagcaattctctccctcagcctcctgccgcacattaactagctgagtgactctccagtattcatggaacggttcagggtctaccttctataaaatgaaggaatgggattaaccatctccaaaatcctccgcaagcacgaactttctatggttgcacaactatttcagggagaacgaagctgcctccatctcccagattattagccatttcgtatgtgggaaccaatgtgaagagtgaagaaatgtgcacgtgcaaagtgaatgtgaggtagctgcaataaaatactaataacttaagctgcgtggggccgccagacacactaggggcggcgcggagccccccgcagccccgggtggtcccagcagggagaggtggcgcggaaagacccccacctccccgcccaggccccgcgggcccgactggggagcacacggcgggggaggggtcggcgcggcagacctaccgctcaggggcgcccggtggggtccgggtcgctgccaactcacccggcggcctggcgggagacccacgccggggcccgctggccctccgctccgccccgcccgcctctggggcttctgcgccgcaccggtttctgctcctgcgccgccgccgcagccacagccacagccaacccggaagcgcg

SEQ ID NO: 2177 - DNA, 2289 bp, Homo sapiens
taacatgtataaaggctttattacaatgcccatcacacagaagttgcacagtaaatggaagctattattatcatcactactcccaattctgcaacacactgcaatcagctttgaaaacatcattacctgtgtggctcctctggtggattgctaaaaagtgattgtacttaaagaccttgccacagtctttacagcgggcctcagggcctccagggcgctttctccttccacagatcctcttggctgaaccatggtcctcttgatccccaacaagtttgtaatctttaagtttgacggatctccaaatcctccgcttgctgtatcgactctggcttgcctggccatcctcggtcttgggatcatagttctcatctttttcaactggcatttcctcctctctacttggctcacaagtaggctccgattcttccttttcttttgctgcaatttgctcattcagtacaccactgtctcctttaaccacaaagttttgtctattctgaactgaattgttcactcttaactgtatttcttcctctgcagccagttctgatttctcctcctgcaatgtattgactttttttggtcttccccgtttccgctttggaggatcgtttttcttattagagataacaaccactggggcaccagcagtgttcaaagttgttggctttggggagctatgattattttggaagtctgtgtaagcctttaccaggtcatagacttttaagaactgagcagtagccaggatttgttctgtacttttctcactggcatggagataacctgtgtagataaattccagcaggataccaaaggtgtctgcaaccatgccttccagcatataaatggattggccgatttccccctcttctgcaaacatcattgagaagtattcactactggcagcaagtaaggctttgtgggcccggaaatgtacattctccacgattaaagtaatgtcacagaggaagcctttcttcctctgatcctcaaaactggccagcacagtgtcactgtgagcgtctgagtgtacaacaagctgcccagaaggctctggcgatgtttctgccattttcttcagaagccactaagggttaaatctgaaataagaaaacaaggtttaaaaaggagaaagcactgtctaaaaggttaatgccagcccacatgaacttcctattcacttcacatcattaactgaattttaccattaccatttttgtctgtctacaaacttagctctgggcccgggcgcagtggcctcacgcctgtaatcccagcactttgggaggccgaggccgacggatcacttgagaccagcctgggcaacatggagagaattcatctatacaaaaaatacaaaaattagcctggcgtggtggcgcccgcctgtggtcccagctactcaggaggctgcggcaggagcatcacctgagcctgggagttcgaggttgccgtgagccgtgatcgtgccactgcactccagcctgggcgacagaacgagaccaccacctcaaaaaacaaaaacaaaacaacttagctcgcggttttttttttttgagacggagtctcgctctatcgcccaggctggagtgcagtggcgcaatctcggctcactgcaacctccgcctcccaggttcaagcaattctctccctcagcctcctgccgcacattaactagctgagtgactctccagtattcatggaacggttcagggtctaccttctataaaatgaaggaatgggattaaccatctccaaaatcctccgcaagcacgaactttctatggttgcacaactatttcagggagaacgaagctgcctccatctcccagattattagccatttcgtatgtgggaaccaatgtgaagagtgaagaaatgtgcacgtgcaaagtgaatgtgaggtagctgcaataaaatactaataacttaagctgcgtggggccgccagacacactaggggcggcgcggagccccccgcagccccgggtggtcccagcagggagaggtggcgcggaaagacccccacctccccgcccaggccccgcgggcccgactggggagcacacggcgggggaggggtcggcgcggcagacctaccgctcaggggcgcccggtggggtccgggtcgctgccaactcacccggcggcctggcgggagacccacgccggggcccgctggccctccgctccgccccgcccgcctctggggcttctgcgccgcaccggtttctgctcctgcgccgccgccgcagccacagccacagccaacccggaagcgcg
